US007468472B2

(12) United States Patent
Cahoon et al.

(10) Patent No.: US 7,468,472 B2
(45) Date of Patent: Dec. 23, 2008

(54) POLYNUCLEOTIDES ENCODING PROTEINS INVOLVED IN PLANT METABOLISM

(75) Inventors: Edgar B. Cahoon, Webster Grove, MO (US); Rebecca E Cahoon, Webster Grove, MO (US)

(73) Assignee: E. I. du Pont de Nemours and Company, Wilmington, DE (US)

( * ) Notice: Subject to any disclaimer, the term of this patent is extended or adjusted under 35 U.S.C. 154(b) by 0 days.

(21) Appl. No.: 11/955,827

(22) Filed: Dec. 13, 2007

(65) Prior Publication Data

US 2008/0104728 A1  May 1, 2008

Related U.S. Application Data

(60) Division of application No. 11/302,607, filed on Dec. 13, 2005, now abandoned, which is a division of application No. 10/062,254, filed on Feb. 1, 2002, now abandoned, which is a continuation of application No. 09/630,346, filed on Jul. 28, 2000, now abandoned.

(60) Provisional application No. 60/146,511, filed on Jul. 30, 1999, provisional application No. 60/156,006, filed on Sep. 23, 1999, provisional application No. 60/156,899, filed on Sep. 30, 1999, provisional application No. 60/157,287, filed on Oct. 1, 1999, provisional application No. 60/169,767, filed on Dec. 9, 1999, provisional application No. 60/171,054, filed on Dec. 16, 1999, provisional application No. 60/172,958, filed on Dec. 21, 1999, provisional application No. 60/171,515, filed on Dec. 22, 1999, provisional application No. 60/173,535, filed on Dec. 29, 1999.

(51) Int. Cl.
*A01H 1/00* (2006.01)
*C07H 21/04* (2006.01)
*C07K 14/415* (2006.01)
*C12N 15/29* (2006.01)

(52) U.S. Cl. .......................... 800/295; 435/6; 435/69.1; 435/468; 435/183; 435/419; 530/370; 536/23.2; 536/23.6; 800/278

(58) Field of Classification Search .................. 435/6, 435/69.1, 468, 183, 419; 530/370; 536/23.2, 536/23.6; 800/278, 295
See application file for complete search history.

(56) References Cited

U.S. PATENT DOCUMENTS 4,945,050 A  7/1990  Sanford et al.
5,773,691 A  6/1998  Falco et al.

FOREIGN PATENT DOCUMENTS

EP  0 242 236 B2  8/1996
WO  WO 98/35044  8/1998

OTHER PUBLICATIONS

Desmond G. Higgins et al., Cabios Comm., vol. 5(2), 151-153, 1989, Establishment of an Efficient medium for Anther Culture of rice . . . .

Chu-Chih-Ching et al., Sci. Sin. Peking, vol. 18:659-668, 1975, Establishment of an Efficient medium for Anther Culture of rice Through comparative . . . .

Joan T. O'Dell et al., Nature, vol. 313:810-812, 1985, Identification of DNA Sequences required for activity of the cauliflower mosaic virus 35S promoter.

T.M. Klein et al., Nature, vol. 327:70-73, 1987, High-velocity microprojectiles for delivering nucleic acids into living cells.

Michael E. Fromm et al., Bio-Technology, vol. 8:833-839, Sep. 1990, Inheritance and Expression of Chimeric Genes in the Progeny of Transgenic Maize Plants.

Jeff J. Doyle et al., Journ. of Biol. Chem., vol. 261 (20):9228-9238, 1986, The Glycosylated Seed Storage Proteins of Glycine ax and *Phaseolus vulgaris*.

Linda Gritz et al., Gene, vol. 25:179-188, 1983, Plasmid-encoded hygromycin B resistance:the sequence of hygromycin B phosphotransferase gene and its expression . . . .

Alan H. Rosenberg et al., Gene, vol. 56:125-135, 1987, Vectors for selective expression of cloned DNAs by T7 RNA polymerase.

F. William Studer et al., J. Mol. Biol., vol. 189:113-130, 1986, Use of Bacteriophage T7 RNA Polymerase to Direct Selective High-Level Expresssion . . . .

Takahiro Yamaguchi et al., The Plant Cell, vol. 16:500-509, 2004, The YABBY Gene Drooping Leaf Regulates Carpel Specification and Midrib Development . . . .

Thomas R. Sinclair et al., Plant Phys., vol. 83:467-468, 1987, Soybean Growth in Response to Long-Term Exposures to Differing Oxygen Partial Pressures.

J. Gale, Journ of Exp Botany, vol. 25 (88):987-989, Oct. 1974, Oxygen Control of Reproductive Growth: Possible Mediation via Dark Respiration.

Jay J. Thelen et al., Journ. of Biol. Chem., vol. 273(41):26618-26623, 1998, Molecular Analysis of Two Pyruvate Dehydrogenase Kinases from Maize.

(Continued)

*Primary Examiner*—Phuong T Bui

(57) ABSTRACT

The invention provides isolated pyruvate dehydrogenase kinase nucleic acids and their encoded polypeptides. The present invention provides methods and compositions relating to altering pyruvate dehydrogenase kinase levels in plants. The invention further provides recombinant expression cassettes, host cells, transgenic plants, and antibody compositions.

11 Claims, 40 Drawing Sheets

OTHER PUBLICATIONS

Mark T. Johnson et al., PNAS, vol. 94:14512-14517, Dec. 1997, Targeted disruption of the murine dihydrolipoamide dehydrogenase gene (Dld) results in perigastrulation lethality.

Paul E. Stephens et al., Eur. J. Biochem., vol. 135:519-527, 1983, Nucleotide sequence of the lipoamide dehydrogenase gene of *Escherichia coli* K12.

Joe Ross et al., Journ. of Gen. Microbiology, vol. 134:1131-1139, 1988, The Nucleotide Sequence of the LPD1 Gene Encoding Lipoamide Dehydrogenase in *Saccharomyces* . . . .

Mark Johnson et al., Genomics, vol. 41:320-326, 1997, Characterization of the Mouse Dihydrolipoamid Dehydrogenase (Dld) Gene: Genomic Structure, Promoter Sequence . . . .

Simon R. Turner et al., Journ. of Biol Chem., vol. 267(11):7745-7750, 1992, Purification and Primary Amino Acid Seq of the L Subunit of Glycine Decarboxylase.

Jacques Bourguignon et al., Biochem. J., vol. 313:229-234, 1996, Glycine decarboxylase and pyruvate dehydrogenase complexes share the same dihydrolipoamide . . . .

Mark Conner et al., Planta, vol. 200:195-202, 1996, Identification and purification of a distinct dihydrolipoamide dehydrogenase from pea chloroplasts.

Laurie A. Stargell et al., Journ. of Biol. Chem, vol. 275(17):12374-12380, 2000, TFIIA Has Activator-dependent and Core Promoter Functions in Vivo.

Jeffrey A. Ranish et al., Science, vol. 255:1127-1129, Feb. 1992, Isolation of Two Genes That Encode Subunits of the Yeast Transcription Factor IIA.

Masaru Ohme-Takagi et al., Plant Cell, vol. 7:173-182, Feb. 1995, Ethylene-Inducible DNA Binding Proteins that Interact with an Ethylene-Responsive Element.

Jack K. Okamuro et al., PNAS, vol. 94:7076-7081, Jun. 1997, The AP2 domain of APETALA2 defines a large new family of DNA binding proteins in *Arabidopsis*.

Armand Seguin et al., Plant Mol. Biol, vol. 35:281-291, 1997, Characterization of a Gene Encoding a DNA-binding Protein that interacts in vitro with Vascular Specific . . . .

Martin F. Yanofsky et al., Nature, vol. 346:35-39, Jul. 1990, The protein encoded by the *Arabidopsis* homeotic gene agamous resembles transcription factors.

Desmond Bradley et al., Cell, vol. 72:85-95, Jan. 1993, Complementary Floral Homeotic Phenotypes Result from Opposite Orientations of a Transposon . . . .

Hans Sommer et al., Embo J., vol. 9(3):605-613, 1990, Deficiens, a homeotic gene involved in the control of flower morphogenesis in Antirrhinum . . . .

Thomas Jack et al., Cell, vol. 68:683-697, The Homeotic Gene APETALA3 of *Arabidopsis thaliana* Encodes a MADS Box and is Expressed in Petals and Stamens.

Wolfgang Trobner et al., Embo J., vol. 11(13):4693-4704, 1992, GLOBSA: a homeotic gene which interacts Deficiens in the control of Antirrhinum . . . .

Koji Goto et al., Genes & Dev., vol. 8:1548-1560, 1994, Function and regulation of the *Arabidopsis* floral homeotic gene PISTILLATA.

Zsuzsanna Schwartz-Sommer et al., Science, vol. 250:931-936, Nov. 1990, Genetic Control of Flower Development by Homeotic Genes in *Antihirrhinum majus*.

Kellee R. Siegfried et al., Development, vol. 126:4117-4128, 1999, Members of the YABBY gene family specify abaxial cell fate in *Arabidopsis*.

Shinichiro Sawa et al., Genes & Dev., vol. 13:1079-1088, 1999, Filamentous Flower, a meristem and organ identity gene of *Arabidopsis*, encodes . . . .

John Alvarez et al., Development, vol. 126:2377-2386, 1999, Crabs Claw and Spatula, two *Arabidopsis* genes that control carpel development . . . .

John L. Bowman et al., Development, vol. 126:2387-2396, 1999, Crabs Claw, a gene that regulates carpel and nectary development in *Arabidopsis* . . . .

Yuval Eshed et al., Cell, vol. 99, 199-209, 1999, Distinct Mechanisms Promote Polarity Establishment in Carpels of *Arabidopsis*.

Steven J. Triezenberg et al., Genes & Dev., vol. 2:718-729, 1988, Functional dissection of VP16, the transactivator of herpes simplex virus immediate early gene expression.

Keith F. Stringer et al., Nature, vol. 345:783-786, 1990, Direct and selective binding of an acidic transcriptional activation domain to the TATA-box factor TFIID.

Young-Sun Lin et al., Nature, vol. 353:569-571, 1991, Binding of General Transcription Factor TFIIB to an acidic activating region.

Carlos Alonso-Blanco et al., Proc. Natl. Acad. Sci., USA, vol. 96:4710-4717, 1999, Natural allelic variation at seed size loci relation to other life history . . . .

Nobuhiro Nagasawa et al., Development, 130:705-718, Superwoman 1 and Drooping Leaf genes control floral organ identity in rice.

NCBI GenBank Identifier AAR84663, printout from website, http://www.ncbi.nlm.nih/gov/entrez/viewer.fcgi?db=protein &val=40362873, printed May 16, 2005, 2 pages.

Andrea Kauffmann-Zeh et al., Science, vol. 268:1188-1190, May 1995, Requirement for Phosphatidylinositol Transfer Protein in Epidermal Growth Factor Signaling.

Masato Ohashi et al., Nature, vol. 377:544-547, Oct. 1995, A role for phosphatidylinositol transfer protein in secretory vesicle formation.

M.A. Kearns et al., Embo J., vol. 17(14):4004-4017, 1998, Novel developmentally regulated phosphoinositide binding proteins from soybean whose expression . . . .

Nathalie Jouannic et al., Eur. J. Biochem., vol. 258:402-410, 1998, Isolation of a cDNA from *Arabidopsis thaliana* that complements the sec 14 mutant of yeast . . . .

Hironobu Tan et al., Eur. J. Biochem., vol. 190:107-112, 1990, A novel peroxisomal nonspecific lipid-transfer protein from *Candida tropicalis*.

Ritsu Yamamoto et al., PNAS, vol. 88:463-467, Jan. 1991, Cloning and expression of a cDNA encoding human steroi carrier protein 2.

Charles L. Baum et al., Journ. of Biol. Chem., vol. 272(10):6490-6498, 1997, Sterol Carrier Protein-2 Overexpression Enhances Sterol Cycling and Inhibits Cholesterol Ester . . . .

Stephen Buratowski et al., Cell, vol. 56:549-561, Feb. 1989, Fiver Intermediate Complexes in Transcription Initiation by RNA Polymerase II.

James H. Geiger et al., Science, vol. 272:830-836, May 1996, Crystal Structure of the Yeast TFIIA/TBP/DNA Complex.

Naoko Kobayashi et al., Mol. & Cell. Biol., vol. 15(11):6465-6473, Nov. 1995, A Class of Activation Domains Interacts Directly with TFIIA and Stimulates . . . .

Jianming Li et al., Science, vol. 272:398-401, Apr. 1996, A Role For Brassinosteroids in Light-Dependent Development of *Arabidopsis*.

Miklos Szekeres et al., Cell, vol. 85:171-182, 1996, Brassinosteroids Rescue the Deficiency of CYP90, a cytochrome P450, Controlling Cell elongation and De-etiolation . . . .

Michele Rouleau et al., Journ. of Biol. Chem., vol. 274(30):20925-20930, 1999, Inactivation of Brassinosteroid Biological Activity by a Salicylate-inducible Steroid . . . .

Karin Schumacher et al., Curr. Opin., Plant Biol., vol. 3:79-84, 2000, Brassinosteroid signal transduction: still casting the actors.

F. Labrie et al., J. Steroid Biochem. Molec. Biol., vol. 41:421-435, 1992, Structure and Tissue-specific expression of 3beta-hydroxysteroid dehydrogenase . . . .

Anita H. Payne et al., Steroids, vol. 62:169-175, 1997, The multiple murine 3beta-hydroxsteroid dehydrogenase isoforms: Structure, function, and tissue . . . .

Andreas Koerte et al., Journ. of Biol. Chem., vol. 270(38):22556-22564, 1995, Suppression of the Yeast Mutation rft-1 by Human p53.

Michael B. Kastan et al., Cell, vol. 71:587-597, 1992, A Mammalian Cell Cycle Checkpoint Pathway Utilizing p53 and GADD45 is Defective in Ataxia-Telangiectasia.

Monica Hollstein et al., Science, vol. 253:49-53, 1991, p53 Mutations in Human Cancers.

Maria Carmen Lopez et al., Journ. of Cell Biol., vol. 124(1):113-127, Apr. 1994, A Phosphatidylinositol/Phosphatidylcholine Transfer Protein Is Required . . . .

Hua Xiao et al., Mol. & Cell. Biol., vol. 14(10):7013-7024, 1994, Binding of Basal Transcription Factor TFIIH to the Acidic Activation Domains of VP16 and p53.

B. Franklin Pugh et al., Cell, vol. 61:1187-1197, 1990, Mechanism of Transcriptional Activation by Sp1:Evidence for coactivators.

Raymond J. Kelleher et al., Cell, vol. 61:1209-1215, 1990, A Novel Mediator between Activator Proteins and the RNA Polymerase II Transcription Apparatus.

Shelley L. Berger et al., Cell, vol. 61:1199-1208, 1990, Selective Inhibition of Activated by Not Basal Transcription by Acidic Activation Domain . . . .

Ken-Ichi Takemaru et al., PNAS, vol. 94:7251-7256, 1997, Multiprotein bridging factor 1 (MBF1) is an evolutionarily conserved transcriptional . . . .

Piotr Chomczynski et al., Analytical Biochem., vol. 162:158-159, 1987, Single-Step Method of RNA Isolation by Acid Guanidinium Thiocyanate . . . .

Mark D. Adams et al., Science, vol. 252:1651-1656, 1991, Complementary DNA Sequencing: Expressed Sequence Tags and Human Genome Project.

Piero Carninci et al., Genomics, vol. 37:327-336, 1996, High-Efficiency Full-Length cDNA Cloning by Biotinylated CAP Trapper.

Stephen F. Altschul et al., J. Mol. Biol., vol. 215:403-410, 1990, Basic Local Alignment Search Tool.

Warren Gish et al., Nature Genetics, vol. 3:266-272, 1993, Identification of protein coding regions by database similarity search.

FIGURE 1A

```
                  *        *    *  ***   ****       *  *** *********    **  ***       ** ***** ******
SEQ ID NO:004     GSNS---EPAARAVAEEVARWGGMRQTGVTLRYMMEFGARPTERNLLSAQFLRRELPIR
SEQ ID NO:010     M-AS---EPVARAVAEEVGRWGSMKQTGVSLRYMMEFGSRPTERNLLLSAQFLQKELPIR
SEQ ID NO:014     MAAKKACETFSKSLIEEVNRWGCLKQTGVSLRYMMEFGSKPTNKNLLISAQFLHKELAIR
SEQ ID NO:024     MMAS---EPVARAVAEEVGRWGSMKQTGVSLRYMMEFGSVPTDRNLLLSAQFLQKELPIR
SEQ ID NO:363     M-AS---EPVARAVAEEVGRWGSMKQTGVTLRYMMEFGSRPTQRNLLLSAQFLHKELPIR
                  1                                                          60

****  *   *  **  * ***  ***  **********  ****************   **   ** ** *****
SEQ ID NO:004     IARRALDLDSLPFGLSTKPAILKVRDWYLDSFRDLRCFPEVRNRDDELAFTEMIKMIRVR
SEQ ID NO:010     IARRALELESLPFGLSRKPAILKVRDWYLDSFRDIRYFPEVRNRNDELAFTQMIKMIKVR
SEQ ID NO:014     IARRAVELENLPYGLSQKPAVLKVRDWYVDSFRDVRAFPDIKNVNDEREFTEMIKAIKVR
SEQ ID NO:024     IARRALELESLPFGLSAKPAILKVRDWYLDSFRDIRYFPEVRNRDDELAFTQMIKMIKVR
SEQ ID NO:363     FARRALELDSLPFGLSNKPAILKVRDWYLDSFRDIRYFPEVRSRNDELAFTQMINMVKVR
                  61                                                         120

**********  **  ****                         **                ****************
SEQ ID NO:004     HNNVVPTMALGVRQLKKDLGGTKAFPPGIDEIHQFLDRFYMSRIGIRMLIGQHVALHEPD
SEQ ID NO:010     HNNVVPTMALGVQQLKNEQYRTKIPTAFDEIHEFLDRFYMSRIGIRMLIGQHVALHDPD
SEQ ID NO:014     HNNVVPTMAMGVQQLKKGM-DPKIVYEDLVEIHQFLDRFYMSRIGIRMLIGQHVELHNPN
SEQ ID NO:024     HNNVVPTMALGVQQLKNEQFSSRKLPPGFEDEIHGFLDRFYMSRIGIRMLIGQHVALHEPE
SEQ ID NO:363     HNNVVPTMALGVQQLKKELGRSRKVPFEFDEIDEFLDRFYMSRIGIRMLIGQHVALHDPK
                  121                                                        180

*  *  *** *  **** ****     *       ****    *  *   ****** ***
SEQ ID NO:004     PEPGVIGLISKRLSPMLVAQHATEDARAICMREYGSAPDVNIYGDPDFTFPYVKLHLQLM
SEQ ID NO:010     PEPGVIGLINTELSPIQVAQAASEDARSICLREYGSAPEIDIYGDPTFTFPYVSSHLHLM
SEQ ID NO:014     PPPHVVGYIHTKMSPVEVARNASEDARSICCREYGSAPDVHIYGDPNFTFPYVPAHLHLM
SEQ ID NO:024     PQPGVIGLINTKLSPIQVAQIASEDARSICMREYGSAPDINIYGDQNLTFPYVTSHLHLM
SEQ ID NO:363     PEPGVIGLINTRLSPIQVAQAACEDARSVCLREYGSAPDINIYGDPNFTFPYVTLHLHLM
                  181                                                        240
```

FIGURE 1B

```
                 *********************  **  ************  ** ****************
SEQ ID NO:004    MFELVKNSLRAVQERYMNSDKHAPPVRIIVADGAEDVTIKISDEGGIPRSGLSRIFTYL
SEQ ID NO:010    LFELVKNSLRAVQERYMNSDKDVPPVRIIVADGAEDVTIKVSDEGGIPRSGLPRIFTYL
SEQ ID NO:014    VFELVKNSLRAVQERFMNSDKVAPPIRIIVADGIEDVTIKVSDEGGIARSGLPKIFTYL
SEQ ID NO:024    LFELVKNSLRAVQERYMNSDKDVPPVRIIVADGTEDVTIKVSDEGGIRRSGLPRIFTYL
SEQ ID NO:363    LFELVKNSLRAVQERYMNSDKDVPPVRIIVADGEEDVTIKVSDEGGIPRSGLPRIFTYL
                 241                                                       300

****  *               *             ********************* 
SEQ ID NO:004    YSTAENPPDLDGR--N-EGVTMAGYYGIPISRLYARYFGGDLQIISMEGYGTDAYLHLS
SEQ ID NO:010    YSTAKNPPDMDCP--S-EGVTMAGYYGYGLPISRLYARYFGGDLQIISMEGYGTDAYLHLS
SEQ ID NO:014    YSTARNPLDEHSDLGIGDNVTMAGYGYGLPISRLYARYFGGDLQIISMEGYGTDAYLHLS
SEQ ID NO:024    YSTAKNLPDMEGP--S-EGVTMAGYGFGLPVSRLYARYFGGDLQIISMEGYGTDAYLHLS
SEQ ID NO:363    YSTAKNPPELDRP--NTERVTMAGYGFGLPISRLYARYFGGDLQIISMEGYGTDAYLHLS
                 301                                                       360

****** ***
SEQ ID NO:004    RLGDSEEPLH
SEQ ID NO:010    RLGDSEEPLP
SEQ ID NO:014    RLGDSQEPLP
SEQ ID NO:024    RLGDSEEPLP
SEQ ID NO:363    RLGDSEEPLP
                 361   370
```

FIGURE 2A

```
            *            *        *           ***      **  *******  **
SEQ ID NO:036  MGLPPHEAINQFKELMDQVD-EPLKRTFKNVHQGYVVETLERFLKAREGNVTKAHKMLVD
SEQ ID NO:042  ----------EALMNQVD-EPLKKTFQNIHQGYPTGTLVRFLKAREWNVPKAHKMLVD
SEQ ID NO:046  MAATSEEAIKQFSALMEQLE-EPLKSTFQNVHQGNLRGTLMRFLKAREWSVPKAYKMLMD
SEQ ID NO:050  MGADSEDAVKQLSLLMEQVE-APLKRSFQNMHQGYPKETLVRFLKAREWNVAKAHKMIVE
SEQ ID NO:058  MAAASEEAIKQFSALMELLD-EPLKTTFQHVHQGYARGTLVRFLKAREWNVPKAHKMLMD
SEQ ID NO:064  MGGGNQEAVKQLQTLMENVDDEQLKNTFQIMHQGYQTETLIREFLKARDWSVAKAHKMLID
SEQ ID NO:068  MGAACDDAVQQLAHLLDQVE-EPLKKTFQNVHQGCPSETLVRFLKAREWHVTNAHKMLVD
SEQ ID NO:072  MAAASEEAIKQFSVLMEQLE-EPLKTTFQNVHQGYPRGTLLRFLKAREWNVPKAYKMLMD
SEQ ID NO:364  MGVGSQDAIKQFQAFIDQVE-EPLRTTFQNVHQGFVTETLMRFLKARDWDPCKAHKMLVD
               1                                                         60

*   * *         *        * ***        *   **  **
SEQ ID NO:036  SLQWRLQNGIDDILAKPIIPANFYRGVRDSQLIGLSGYTREGLPVFAIGAGLSTFDKASI
SEQ ID NO:042  CLNWRVENDIDNILAKPIVPTDLYRGVRDSQLIGLSGYTKEGLPVFAIGAGFSTFDKASV
SEQ ID NO:046  CLNWRIQNEIDIVLAKPILPSDIYRVIRDTLLVGLTGYSKQGQPVYAFGVGLSTFDKASV
SEQ ID NO:050  CLNWRIQNEIDSVLERPIVPVDLYRSIRDSQLIGLSGYTKEGLPIFGIGVGHSTYDKASV
SEQ ID NO:058  CLNWRIQNGIDSVLAKPIVPSDLYRTIRDTLLVGLTGYSKQGQPVYAFGVGLSTLDKASV
SEQ ID NO:064  CLNWRVENEIDNVLRKPI-PTDLYKAIRDSQLIGMSGYSKEDLPVIAVGVGLSTYDKASD
SEQ ID NO:068  CLNWRIQNEIDSILEKPITPVDLYRSIRESQLVGLSGYSKEGVPVFAFGVGQSTYDKASV
SEQ ID NO:072  CLNWRLQNEIDSVLAKPILPADLYRSIRDTLLVGLTGYSKQGQPVYAFGVGLSTFDRASV
SEQ ID NO:364  CLNWRVQNEIDNILSKPIVPADLYRAVRDSQLIGLSGYSREGLPVFAIGLSGYSTFDKASV
               61                                                        120
```

FIGURE 2B

```
                      *  ******   **  *  **  * * *** *** *** ***    *                                *
SEQ ID NO:036         HYYVQSHIQINEYRDRVILPAATKRNGKYIGKCVKVLDMSGLKLSALNQIKLLTTISTVD
SEQ ID NO:042         HYYVQSHIQINEYRDRVILPSASKKHGRHITSCVKVLDMTGLKLSALSQIKLLTIMSTID
SEQ ID NO:046         NYYVQSHIQMNEYRDRVVLPAASKKFGRQINTCLKVMDMTGLKLSALSQIKMLTMITTVD
SEQ ID NO:050         HYYVQSHIQINEYRDRIILPRLTQQFGRPVTSCIKVLDMTGLKLSALSQIKMLTSISTVD
SEQ ID NO:058         HYYVQSHIQINEYRDRVVLPKASKMFGKQINTCLKVMDMTGLKLSALNQIKMLSTITAID
SEQ ID NO:064         KYYIQSHIQLNEYRDRVILPTATRKHGRYIGTCVKVLDMSGLKFSALNQLRLLTAISTID
SEQ ID NO:068         HYYVQSHIQINEYRDRVILPMATKKFRRPITTCIKVLDMTGLKLSALSLLKILTAISAVD
SEQ ID NO:072         NYYLQSHIQMNXYRDRVVLPGASEMSGKQINTCLKVMDMTGLKLSALNQIKMLSTITAVD
SEQ ID NO:364         HYYVQSHIQINEYRERIILPSASKKQGRPITTCIKVLDMTGLKLSALNQIKLLTIISSID
                      121                                                          180

*  ****   *   *  ****  * ***** *************** *** * ***  *
SEQ ID NO:036         DLSYPEKTITYYIVNVPYIFSACWKVVKPLLQERTKLKIRVLQGGGRDELLKIMDYPSLP
SEQ ID NO:042         DLNYPEKTNTYYIVNAPYIFSACWKVVKPLLQERTRKKIQVLPGCGRDELLKIMDYASLP
SEQ ID NO:046         DLNYPEKTETYYVVNVPYIFSACWKVVKPLLQERTKKKIQVLYGSGRDELLKVMDYESLP
SEQ ID NO:050         DLNYPEKTETYFIVNVPYVFSACWKVVKPLLQERTKKKKVLTGCGRDELLKIMDYSSLP
SEQ ID NO:058         DLNYPEKTETYYIVNAPYVFSACWKVVKPLLQERTKRKIKVLYGSGRDELLKVMDYEALP
SEQ ID NO:064         DLNYPEKTDTYYIVNAPYVFSACWKVVKPLLQERTRRKIQVLQGCGKEELLRVMDYASLP
SEQ ID NO:068         ELNYPEKAETYYIVNAPYVFSACWKVVKPLLQERTRKKVHVLSGRGKDELLKIMDHSSIP
SEQ ID NO:072         DLNYPEKTETYYIVNAPYIFSACWKVVKPLLQERTKKKKIKVLYGPGRDELLKVMDYASLP
SEQ ID NO:364         DLNYPEKTNTYYIVNAPYIFSACWKVVKPLLQERTRRKIQVLPGCGRDELLTIMDYSSLP
                      181                                                          240
```

FIGURE 2C

```
                        *  *    *  ** *                              *
SEQ ID NO:036   HFCRRDGSGSGSSGSGAGNSNDNCYSLNHPFHQELYNYMRELSGI-DEPKEPTKQGSIH
SEQ ID NO:042   HFCRRREGSSGSSRHSGNET----DNCYTLDHPFHQQLYNYIKEQASI-IAPAGPYKQGSIH
SEQ ID NO:046   HFCKREGSGSSSDSLDGV-----DCYSYDHPFHQQLYNYMKQQQSLNQDSVGPRKQGSVH
SEQ ID NO:050   HFCRREGSGSSKHSSTDV-----DNCFSLDHPFHKELYGHIREQA---SRRELIKMGSLH
SEQ ID NO:058   NFCKREGSGSSNDSSDGV-----DCYSYDHPFHQELYNYIKQQAL-NEDFIGPIKQGSMH
SEQ ID NO:064   HFCRKEDSKSSKHHASG---NSENCFSFNHAFHQQLYNHIKQQAII-MESISPIRQGSFC
SEQ ID NO:068   HFCRREGS--SKASLSSI----DDCFSLDHPFHQELYHYIEQQA----LNQELIKQGSLH
SEQ ID NO:072   HFCKREGSGSGS--SSDEV-----DCYSYDHPFHQELYNYVKQQALRNQDSVGPAKQGSMH
SEQ ID NO:364   HFCRREGSGSSRHSESGS-----ENCYSLDHPFHQELYNHIKQQARL-REAVEPIKQGSFH
                241                                                       300

*   *
SEQ ID NO:036   VEVPMGDHKGVELHRTLESELMKLRTR-KSLSGSLEKVKISD---
SEQ ID NO:042   VHLPESAVEESEIAKTIESELQKFGNQ-TRLTDSLDALKVSDNRN
SEQ ID NO:046   VDVPSPGLEEAKIAETIKAELQNLRGS-GGLAHSFSSIQIEGP--
SEQ ID NO:050   VSIPEPDPDDAKIVEVIQAEFQKIGEQ-DESTNS------HKD
SEQ ID NO:058   VDVPTPDLEEAKIMETIESELHKFSGA-NGLSHSFNKIKIEGP--
SEQ ID NO:064   VDIPEPDPDDAKIAKTIENEFHKLENQKNGFTNSLTGLTVNGH--
SEQ ID NO:068   VDIPDQDPDDAMIVEVIQAEFHKLGEQ-NGSADG------DQK
SEQ ID NO:072   VRVPTPDLEEAKIMETIQSELHNLKGG-DGISRSFSRITIEGP--
SEQ ID NO:364   VDFPVPPDDEVEIAKTIESELHKFENG-NGV--------
                301                                         345
```

FIGURE 2D

```
                *   **   *    *   **    **    **    *    **    *   ******
SEQ ID NO:054                           ------EGEWLKVSQLRPMVEAQDPNAKAVDNLTRRFLRA
SEQ ID NO:365   MASAAGG--GAAG-----------
                MEAVRAGREGAIGLGQGDGVAKDSTETELTKIRLLRAIVETRDPSSKEEDDFMIRRFLRA  60
                1

** ** ****** ** ****    *   ***   *  **** *     * *   ****
SEQ ID NO:054   RDHDVDKASAMFLKFELRWRAEAAPGGGTVREEQVRGELEQDKIYMGGVDRTGRPIIVGLL
SEQ ID NO:365   RDLDVEKASAMLLKYLKWRNSFVPNGS-VSVSDVPNELAQDKVFMQGHDKIGRPILMVFG  120
                61

*           *** ****  ** *  ****** *    ********** *  *  *
SEQ ID NO:054   AKHYSANRDMAEFKSFVVYFFDKICARIPRGQEKFLAIMDLKGWGYANCDVRAYIAAIEI
SEQ ID NO:365   GRHFQNKDGLDEFKRFVVYVLDKVCASMPPGQEKFVGIAELKGWGYSNSDVRGYLSALSI  180
                121

*    *********  *    ******     *  **     *    *  ***
SEQ ID NO:054   MQNYYPERLGKALMINVPYIFLKVWKTMIYPFIDANTRDKFVFVDDKSLRETLRREIDES
SEQ ID NO:365   LQDYYPERLGKLFIVNAPYIFMKVWQ-IVYPFIDNKTKKKIVFVEKNKVKSTLLEEMEES  240
                181

* *** * ****  ***    *
SEQ ID NO:054   QLPEFLGGKMPLVSLKDYAQQPQPVCE
SEQ ID NO:365   QVPEIFGGSLPLVPIQD--------S  267
                241
```

FIGURE 3

```
              *  **  *****   ** *****   **  ***** **  ** ************
SEQ ID NO:080 MAGIGPIRQDWEPVVRKKAPTAAAKKDEKAVNAARRAGAEIDTMKKYNAGTNKAASSGT
SEQ ID NO:082 MAGIGPIRQDWEPVVRKKAPTAAAKKDEKAVNAARRSGAEIETMKKYNAGTNKAASSGT
SEQ ID NO:084 MSGVGPLSQDWEPVVLRKKAPTAAAKKDEKAVNAARRSGAEIETLKKYNAGTNKAASSST
SEQ ID NO:086 MAGIGPIRQDWEPIVVRKKAQNAADKKDEKAVNAARRSGAEIDTTKKYNAGTNKAASSGT
SEQ ID NO:366 MAGVGPISQDWEPVVIRKKAPTAAAKKDEKVVNAARRAGAEIETLKKSNAGTNKAASSST
              1                                                          60

*****  **  ***** **  *         *  **  ***** ****   ****
SEQ ID NO:080 SLNTKRLDDDTENLAHERVPSDLKKNLMQARLDKKLTQAQLAQMINEKPQVIQEYESGKA
SEQ ID NO:082 SLNTKRLDDDTESLAHERVSSDLKKNSCKQGWDKKMTQAQLAQMINEKPQVIQEYESGKA
SEQ ID NO:084 SLNTKRLDDDTESLAHEKVPTELKKAIMQARMDKKLTQSQLAQLINEKPQVIQEYESGKA
SEQ ID NO:086 SLNTKRLDDDTENLSHERVSSDLKKNLMQARLDKKMTQAQLAQMINEKPQVIQEYESGKA
SEQ ID NO:366 SLNTRKLDEETENLTHDRVPTELKKAIMQARMEKKFTQAQLAQMINEKPQIIQEYESGKA
              61                                                         120

**  **  ****  **   **     *
SEQ ID NO:080 IPNQQIISKLERALGTKLRAR---K
SEQ ID NO:082 YPNSSI-GKL-KGLGTNSRQEIMSQ
SEQ ID NO:084 IPNQQIIGKLERALGAKLRGK---K
SEQ ID NO:086 IPNNQIIGKLERALGAKLRSK---K
SEQ ID NO:366 IPNQQIIGKLERALGVKLRGK---K
              121                                    145
```

FIGURE 4A

```
                  *       *         *       *          *      *     *    *
SEQ ID NO:092     MGSTAAVSVSASAIASRGCARSEAA------RRPGGIRVCGLRSEVL---TCHSLRIS
SEQ ID NO:102     MHSSLSLSFSATSSSVATVSRSRHSFHSPAAAM--PLNLRFCGLRRDAFG----SGLAAS
SEQ ID NO:367     MQSAMALSFSQTS------FTRPNHVLGSSGSVFSTPRSLRFCGLRREAFGFSTSNQLAIR
                  1                                                          60

*           ***** **************** *************** **
SEQ ID NO:092     QAPARLTVARPP---PPAAATNGAAAGTCGFDYDLVIIGAGVGGHGAALHAVEEGLKTAI
SEQ ID NO:102     LNRYHSHLPRRPHSAAVSAALSSNGSPPKSFDYDLLIIGAGVGGHGAALHAVEKGLKTAI
SEQ ID NO:367     SNRIQ-FLSRKSFQVSASASSNGNGAPPKSFDYDLIIIGAGVGGHGAALHAVEKGLKTAI
                  61                                                        120

********** ********** ****** ** ****** *********  ********
SEQ ID NO:092     IEGDVVGGTCVNRGCVPSKALLAVSGRMRELHDEHHMKSLGLQVSSPGYDRQAVADHANN
SEQ ID NO:102     VEGDVVGGTCVNRGCVPSKALLAVSGRMRELRSDHHLKSFGLQVSAAGYDRQGVADHANN
SEQ ID NO:367     IEGDVVGGTCVNRGCVPSKALLAVSGRMRELQNEHHMKSFGLQVSAAGYDRQGVADHANN
                  121                                                       180

** *** **************** ************  ***    ** ***********
SEQ ID NO:092     LASKIRMNLTNSMKALGVDILTGVGTIVGKQKVRYGKAGFPDKEITARNIIIATGSVPFV
SEQ ID NO:102     LASKIRNNLTNSMKALGVDILTGFGTILGPQKVKVGS---SDKIVTAKNIIIATGSVPFV
SEQ ID NO:367     LATKIRNNLTNSMKAIGVDILTGFGSVLGPQKVKYGK----DNIITAKDIIIATGSVPFV
                  181                                                       240

***** ***** *** ************* ********** *** **************
SEQ ID NO:092     PKGIEIDGKTVFTSDHALKLESVPDWIAIVGSGYIGLEFSDVYTALGSEVTFVEALDQLM
SEQ ID NO:102     PKGIEIDGKTVITSDHALKLESVPDWIAIVGSGYIGLEFSDVYTALGSEVTFIEALDQLM
SEQ ID NO:367     PKGIEVDGKTVITSDHALKLESVPEWIAIVGSGYIGLEFSDVYTALGSEVTFIEALDQLM
                  241                                                       300
```

FIGURE 4B

```
                  ******  ****************  *****  ******************************** *  *****
SEQ ID NO:092     PGFDPEIAKLAQRVLINPRKIDYHTGVFASKITPAKDGKPVLIELIDAKTKEHKETLEVD
SEQ ID NO:102     PGFDPEISKLAQRVLINPRNIDYHTGVFATKITPARDGKPVLIELIDAKTKEPKDTLEVD
SEQ ID NO:367     PGFDPEISKLAQRVLINPRKIDYHTGVFASKITPARDGKPVLIELIDAKTKEPKDTLEVD
                                                                               360
                  *********  ****  ****  * **************** *  ** *  ************* **
SEQ ID NO:092     AALIATGRAPFTKGLGLENINVVTQRGFVPVDERMRVMDADGNVVPNLYCIGDANGKLML
SEQ ID NO:102     AALIATGRAPFTQGLGLENIDVVTQRGFVPVDEHMRVIDANGKLVPHLYCIGDANGKMML
SEQ ID NO:367     AALIATGRAPFTNGLGLENVNVVTQRGFIPVDERMRVIDGKGTLVPNLYCIGDANGKLML
                                                                               420
                  *********  *   ***************  ** *************** ****  **
SEQ ID NO:092     AHAASAQGISVVEQISGKDHILNHLSIPAACFTHPEISMVGLTEPQAREKADKEGFEVNV
SEQ ID NO:102     AHAASAQGISVVEQVTGKDHVLNHLSIPAACFTHPELSMVGLTEPQARVKGEKEGFEVSV
SEQ ID NO:367     AHAASAQGISVVEQVSGRDHVLNHLSIPAACFTHPEISMVGLTEPQAKEKGEKEGFKVSV
                                                                               480
                  ***  **************  **  ***************  ************************
SEQ ID NO:092     VKTSFKANTKALAENEGDGIAKLIYRPDTGEILGVHILGLHAADLIHEASNAIALGTRVQ
SEQ ID NO:102     AKTSFKANTKALAENEGEGLAKLIYRPDNGEILGVHIFGLHAADLIHEASNAIALGTHIQ
SEQ ID NO:367     VKTSFKANTKALAENEGEGIAKMIYRPDNGEILGVHIFGLHAADLIHEASNAIALGTRIQ
                                                                               540
                  ***  *******************  ***                 *   *
SEQ ID NO:092     DIKFAVHAHPTLSEVLDELFKAAKVNS-GVSHSVNEPVAA
SEQ ID NO:102     DIKFAVHAHPTLSEVLDELFKSAKVKAQASSP-VSEPVAV
SEQ ID NO:367     DIKLAVHAHPTLSEVLDELFKAAKVESHATTRTVSEKVVV
                                                        580
```

FIGURE 5A

```
                    *         *         *         *         *         *
SEQ ID NO:106   ME------------------------------SSLKSAALLEQMKLHLKTDAGKDITKKIGLVYQLNI
SEQ ID NO:108   MA----------------------SDSSATQLKSDALMEQMKQHLSTDAGKAVTKKIGLVYQINI
SEQ ID NO:110   MD---------------------S-----SSLKSAQLLELMRQHLATDAGKEVTKKVGLVYQLNI
SEQ ID NO:112   MD---------------------S-----SSLKSAQLLELMRQHLATDAGKEVTKKVGLVYQLNI
SEQ ID NO:114   MA---------------------AE----LKSESVFDLLKRFLETDEGIELRKKINLVYQFNI
SEQ ID NO:116   MD---------------------G-----SSLKSAQLLEQMRLHMATDAGKDIAKKVGLVYQFNI
SEQ ID NO:118   MA---------------------D-----SSSNLKSDAIMEQMKQHLATDSGKQVTKKIGLVYQIQI
SEQ ID NO:120   MA---------------------------SSDLKSAALMEQMNTHFSTDAGKALTKKIGLVYQLNI
SEQ ID NO:124   ME---------------------A-----SKLKAARLLEQMSAHLATDAGKEIANKVGFVYQLNI
SEQ ID NO:126   MA---------------------E-----SSQLKSDALLEQMKKHLSSDAGKDLIEKIGLVYQINI
SEQ ID NO:368   MGFPEAASSFRTHQIEAVPTSSASDGFKANLVFKEIEKKLE-EEGEQFVKKIGGIFAFKV
                1                                                            60

*         *         *         *         *         *
SEQ ID NO:106   APKKIGVDEEIFVVDLKEGKVTKGPYEG-KPDATFSFTDSDFLSIATGKMNPQMAFIRGA
SEQ ID NO:108   APKKIGFDEVVYIVDLKKGEVTKGPYEG-KPDATFSFKDDDFIKVATGKMNPQIAFMRGA
SEQ ID NO:110   APKKIGVDEEIFVVDLKKGEVTKGPYEG-KPDATFSFTDNDFLGIATGKTNPQIAFIRGA
SEQ ID NO:112   APKKIGVDEEIFVVDLKKGEVTKGPYQG-KPDATFSFTDNDFLGIATGKTNPQIAFIRGA
SEQ ID NO:114   APKKIGVDEEIFVVDLKKGEVTKGPYQG-KPDATFSFTDNDFLGIATGKTNPQIAFIRGA
SEQ ID NO:116   APKKIGIDEVSYTVNLKKGEVTKGPYEGGKPDATFSLKDEDFVKLAEGKLNPQIAFMRGT
SEQ ID NO:118   APKKIGIDEVVTVDLRKGEVTKGPYEGGKPDATFSFTDSDFLSIATGKMNPQIAFMRGA
SEQ ID NO:120   APKKLGIDEVVYTVDLKKGEVTKGPYEGGKPDASFSFKDEDFVKVALGKMNPQIAFMRGA
SEQ ID NO:124   APKKLGFNEEIYVVDLKKGEVTKGPYEGGKPDATFSFTDEDFFKIATGKMNPQIAFMRGK
SEQ ID NO:126   SPKKMGVDEEIFVVDLKKGAVSTGKYEG-TPDAAFTFTDDDFLAIASGKLNPQMAFIRGK
SEQ ID NO:368   APKKIGYDEVVYVVNLKKGDVTKGPYEGGKPDATFSFKDDDFVKVATGKMNPQMAFMRGA
                KDGP-GGKEATWVVDVKNGKGSVLPNSDKKADCTITMADSDFLALMTGKMNPQSAFFQGK
                61                                                          120
```

FIGURE 5B

```
                        *           *     *    *
SEQ ID NO:106    MKIKGSIGAATKFTP-GYFPKPSKM
SEQ ID NO:108    MKIKGSLSAAQKFTP-DIFPKPSKM
SEQ ID NO:110    IRSKGNISAAQKFTL-TS-SQAAKL
SEQ ID NO:112    IKIKGSISAAQKFTP-DIFPKPAKL
SEQ ID NO:114    LKIKGNLSAAQKFTP-DIFPKPSKL
SEQ ID NO:116    IKIKGSISAAQKFTP-DIFPKPSKL
SEQ ID NO:118    MKIKGSLSAAQKFTP-DIFPKPSKL
SEQ ID NO:120    MKVKGSLSAAQKFTP-RIFPKPSKL
SEQ ID NO:124    LKIKGSISAAQKFTP-DIFPKPSKM
SEQ ID NO:126    MKIKGSMTAAQKFTP-EIFPKPSKM
SEQ ID NO:368    LKITGNMGLAMKLQNLQLQPGNAKL
                 121                     145
```

FIGURE 6A

```
                *******                                *  *     *  * *** * *  ***   ***
SEQ ID NO:128   M-------------DTV-----SQSEHLCYVRCTYCNTVLAVGVPCKRLMDTVTVKCGH
SEQ ID NO:130   M-------------DMV-----SQSEHLCYVRCTYCNTVLAVGVPCKRLMDTVTVKCGH
SEQ ID NO:134   MSAQ----E-------------ASEHACYVNCNYCNTILVNVPSSCSYNVTVKCGH
SEQ ID NO:138   MSSAP---------LQIAPVP-EHVCYVHCNFCNTILAVSVPHSHSMLNIVTVRCGH
SEQ ID NO:140   MMSSSSSSSSAACCFPLDHLAPSPTEQLCYVHCNCCDTILAVGVPCSSLFKTVTVRCGH
SEQ ID NO:142   MMSSSSSSSSAACCFPLDHLAPSPTEQLCYVHCNCCDTILAVGVPCSSLFKTVTVRCGH
SEQ ID NO:144   MSSA--QIA-------------PADHVCYVHCNFCNTVLAVSVPGNSMLSMVTVRCGH
SEQ ID NO:146   MSSA--QIA-------------PADHVCYVHCNFCNTVLAVSVPGNSMLSMVTVRCGH
SEQ ID NO:148   MSSS--QIA-------------PADHVCYVHCSFCNTVLAVSVPGNSMLNIVTVRCGH
SEQ ID NO:152   MSA---QIA-------------PAEQVCYVHCNFCNTILAVSVPGNSMLNIVTVRCGH
SEQ ID NO:154   MNHEDKLT--------MDLV--PPSEHLCYVRCNFCNTVLAVGIPCKRLLDTVTVKCGH
SEQ ID NO:156   MSSSSTT-------LSLDHLPPS--EQLCYVHCNICDTVLAVSVPCTSLFKTVTVRCGH
SEQ ID NO:158   MSSSSTT-------LSLDHLPPS--EQLCYVHCNICDTVLAVSVPCTSLFKTVTVRCGH
SEQ ID NO:162   MSM---DMM-------------ATERVCYVHCNFCNTTLAVSVPCSSLLTIVTVRCGH
SEQ ID NO:164   MSM---EMM-------------ATERVCYVHCNFCNTILAVSVPYSSLLTIVTVRCGH
SEQ ID NO:166   MSM---EMM-------------ATERVCYVHCNFCNTILAVSVPYSSLLTIVTVRCGH
SEQ ID NO:170   MQ-----S-------MDLV---SPSEHLCYVRCTYCNTVLAVGVPCKRLMDTVTVRCGH
SEQ ID NO:174   MSSSGQIT--------------PAEEVCYVHCNFCNTVLAVSVPGNSMLNIVTVRCGH
SEQ ID NO:176   MS-A-QIA--------------PPEHVCYVHCNFCNTILAVSVPSNSMLNIVTVRCGH
SEQ ID NO:369   MNLEEKPT------MTASR-ASPQAEHLYYVRCSICNTILAVGIPLKRMLDTVTVKCGH
                1                                                           60
```

FIGURE 6B

```
             *                    *              *
SEQ ID NO:128  CNNL------SYLSPRPP-MVQP-------LSPTDH--PLGPFQCQG-------------------
SEQ ID NO:130  CNNL------SYLSPRPP-MVQP-------LSPTDH--PLGPFQCQG-------------------
SEQ ID NO:134  CTMVLSMDLSP-----------FH-------------QQARTVPDNQVVQNRGFQY
SEQ ID NO:138  CTSLLSVNLRGLIQSLPVQ----NHHYSQ--------------------QQENFTV
SEQ ID NO:140  CANLLSVNLRGLLLPPAAPAPPNHLNFAHSLLSPTSPHGLLDELALQQAPSFLMEQASAN
SEQ ID NO:142  CANLLSVNLRGLLLPPAAPAPPNHLNFAHSLLSPTSPHGLLDELALQQAPSFLMEQASAN
SEQ ID NO:144  CTNLLSVNLRALMHSV--PEQD-QLQ--------------ENIRVHG---TLREH-HQC
SEQ ID NO:146  CTNLLSVNLRALMHSV--PEQD-QLQ--------------ENIRVHG---TLREH-HQC
SEQ ID NO:148  CANLLSVNLRALTHSL--PEQDHQLQ--------------ENIKVHGINGTLHDD-HQC
SEQ ID NO:152  CTNLLSVNLRGLMHSA--PALQDHHH--------------HHLQESGLSGCFRDQ-SGY
SEQ ID NO:154  CSNL------SFLSTRPP-SSQN-------QSIDHTTLSLQGFYSNA-------------
SEQ ID NO:156  CTNLLPVNMRGLLMP-----SPTQFHLGHSFFSP--SHNLLEEIP-NPSPNFLMNQ--TN
SEQ ID NO:158  CTNLLPVNMRGLLMP-----SPTQFHLGHSFFSP--SHNLLEEIP-NPSPNFLMNQ--TN
SEQ ID NO:162  CANLLTVNMGASLQTFPSQDTTQRFS------------TVGKLQRQHLSV-QEACS----
SEQ ID NO:164  CANLLSVNMGASLQAFPPQDP-------------------QKQLLSF-EEPSSC------
SEQ ID NO:166  CANLLSVNMGASLQAFPPQDP-------------------QKQLLSF-EEPSSC------
SEQ ID NO:170  CNNL------SFLSPRPPPMVQP-------LSPNDHHHPMGPFQGW--------------
SEQ ID NO:174  CTNLLSVSLRGQMHSPVPPAAQVQES-----------SLSKPNGSNGFIRDHGSAY----
SEQ ID NO:176  CTSLLSVNLRGLIQSP--PVQDHS-Q-----------ENFKAHNI--SFRGN-YP-----
SEQ ID NO:369  CGNL------SFLTTTPP-LQGH--------VSL---TLQMSFGGSD-------------
              61                                                           120
```

FIGURE 6B CONTINUED

```
                                                                           *           **                      *
SEQ ID NO:128   ------------PCSECRRNQPLP-LASPTSTDLTPR---MPFVVKPPEKKHRLPSAYNRF
SEQ ID NO:130   ------------PCNDCRRNQPLP-LASPSSTELSPR---MPFVVKPPEKKHRLPSAYNRF
SEQ ID NO:134   NN--FGSYEQASSRNLRTPPMYP------VSNNQPQVPPIRPSEKRQRVPSAYNRF
SEQ ID NO:138   QNMGFTENYPEYAPSYRMP---TTLSAKGDLDHMLHV--------RGSNDCGFF
SEQ ID NO:140   LSSTMTGRSSNSSCASNLPPPAPMPAAQPVQQEAELPKTAPSVNRPPEKRQRVPSAYNRF
SEQ ID NO:142   LSSTMTGRSSNSSCASNLPPPAPMPAAQPVQQEAELPKTAPSVNRPPEKRQRVPSAYNRF
SEQ ID NO:144   GGGHHLELGSSSSSRFRLPMM---MSYAPQNEHLLQEQTLNNARPAPEKRQRVPSAYNRF
SEQ ID NO:146   GGGHHLELGSSSSSRFRLPMM---MSYAPQNEHLLQEQTLNNARPAPEKRQRVPSAYNRF
SEQ ID NO:148   --GHLDQLGSSSSSRFRRLPV---MCSPQNGQHLLQEKTLNNNARPPEKRQRVPSAYNRF
SEQ ID NO:152   --PEFGFSAASSSSKLRLPPAAAMVSYSQQNQQL-EQALHA---RPPEKRQRVPSAYNRF
SEQ ID NO:154   ------------KKGQASSSSSSPTTSNESVSPKAASFVVKPPEKKHRLPSAYNRF
SEQ ID NO:156   LSAS----------NEXSMPARIAAD-------ELPR---PIMNRPPEKRQRVPSAYNRF
SEQ ID NO:158   LSAS----------NEFSMPARIAAD-------ELPR---PIMNRPPEKRQRVPSAYNRF
SEQ ID NO:162   KELGSSS-KCKT--F-------ETVDHDQQPRIPPIRPPEKRQRVPSAYNRF
SEQ ID NO:164   KELGSSSSKCNKIAPF-----------HEAVEHEQPRIPPIRPTEKRHRVPSAYNRF
SEQ ID NO:166   KELGSSSSKCNKIAPF-----------HEAVEHEQPRIPPIRPTEKRHRVPSAYNRF
SEQ ID NO:170   ------------TDCRRNQPLPPLASPTSSDASPR---APFVVKPPEKKHRLPSAYNRF
SEQ ID NO:174   NSPEFASSSSSSSKFRMPT-----MMFSSQNDLLQEQTLHA---RPPEKRQRVPSAYNRF
SEQ ID NO:176   --DYGTSSKYRMPMM---FSTKSDQEHMLH-------MRPAPEKRQRVPSAYNRF
SEQ ID NO:369   ------------YKKGSSSSSSSTSSDQPPSP-SPPFVVKPPEKKHRLPSAYNRF
                121                                                        180
```

FIGURE 6C

```
                    *              *                *                          *
SEQ ID NO:128   MREEIQRIKAAKPDIPHREAFSMAAKNWAKCDPRCSTTASTATSNSAPEPARVVVPTPHV
SEQ ID NO:130   MREEIQRIKAAKPDIPHREAFSMAAKNWAKCDPRCSTAASTETSNSAPAEPRVV-PTPQL
SEQ ID NO:134   IKEEIQRIKTSNPEISHREAFSAAAKNWAHL-PRLHFGLSVADGGGGSN-----------
SEQ ID NO:138   V---MSYMKSYDHNAGVISSFNQPDNSRD-------------------------------
SEQ ID NO:140   IKDEIQRIKAGNPDITHREAFSAAAKNWAHF-PHIHFGLMP--DQGLKKTFKTHQDGAED
SEQ ID NO:142   IKDEIQRIKAGNPDITHREAFSAAAKNWAHF-PHIHFGLMP--DQGLKKTFKTHQDGAED
SEQ ID NO:144   IKEEIRRIKANNPDISHREAFSTAAKNWAHY-PNIHFGLNSGREGGKN--KLVDE-----
SEQ ID NO:146   IKEEIRRIKANNPDISHREAFSTAAKNWAHY-PNIHFGLNSGREGGKN--KLVDE-----
SEQ ID NO:148   IKEEIRRIKANNPDINHREAFSTAAKNWAHY-PNIHFGLDDSGREGKK--KLVDHEAAAS
SEQ ID NO:152   IKEEIRRIKANNPDISHREAFSTAAKNWAHY-PNIHFGLSPGHEGGK----KLVDVDP--
SEQ ID NO:154   MKEEIQRIKAANPEIPHREAFSAAAKNWARFIPNSPTSSVSATK----------------
SEQ ID NO:156   IKDEIQRIKSVNPDITHREAFSAAAKNWAHF-PHIHFGLMP--DQTVKKTNVCQQEG-EE
SEQ ID NO:158   IKDEIQRIKSVNPDITHREAFSAAAKNWAHF-PHIHFGLMP--DQTVKKTNVCQQEG-EE
SEQ ID NO:162   IKEEIQRIKASNPDISHREAFSSAAKNWAHF-PHIHFGLK---LDGNKQAKLDQGD----
SEQ ID NO:164   IKEEIQRIKASNPDISHREAFSSAAKNWAHF-PHIHFGLKNLKLDGNKQEKLDQGE----
SEQ ID NO:166   IKEEIQRIKASNPDISHREAFSSAAKNWAHF-PHIHFGLKNLKLDGNKQEKLDQGE----
SEQ ID NO:170   MREEIQRIKAAKPDIPHREAFSMAAKNWAKCDPRCSTTVSA--SNSAPE-PRIVVPGPQ-
SEQ ID NO:174   IKEEIRRIKANNPDISHREAFSTAAKNWAHY-PNIHFGLNPERDGGK---RLAVDD----
SEQ ID NO:176   IKEEIRRIKTNNPDISHREAFSTAAKNWAHF-PNIHFGL--GSNESSK--KLDE------
SEQ ID NO:369   MRDEIQRIKSANPEIPHREAFSAAAKNWAKYIPNSPTSITSGGHN---------------
                181                                                          240
```

FIGURE 6D

```
                              *
SEQ ID NO:128    TEPRFDLEDRAKEHVIESFDIFKQIERNI----
SEQ ID NO:130    TEPRFDLEDRAKGQVIESFDIFKHIERSI----
SEQ ID NO:134    -LRAHALHQLTFHRINKVLPLPLDIQRFMFARN
SEQ ID NO:138    MLLKDDLYAAAAAAAANMGIT------PF----
SEQ ID NO:140    MLLKDDLYAAAAAAAANMGIT------PF----
SEQ ID NO:142    --A-----VAAVAVAPKKIQGF------Y----
SEQ ID NO:144    --A-----VAAVAVAPKKIQGF------Y----
SEQ ID NO:146    VVA-----VAAAPTAAKKIQGF------Y----
SEQ ID NO:148    ----------IPTAPSSKKIQGF------YS---
SEQ ID NO:152    ---------------VNAD--------------
SEQ ID NO:154    VLMKDGFYA-------SANVGVS-----PY---
SEQ ID NO:156    VLMKDGFYA-------SANVGVS-----PY---
SEQ ID NO:158    ----------------GTQKSNGF-----Y---
SEQ ID NO:162    ----------------GAEKSNGF-----Y---
SEQ ID NO:164    ----------------GAEKSNGF-----Y---
SEQ ID NO:166    ------LQERATEQVVESFDIFKQMERSA----
SEQ ID NO:170    ----------AAPAAKKIQGF-------CS---
SEQ ID NO:174    ----------AIAAPTPQKVQGL-----Y----
SEQ ID NO:176    ---------MIHGLG-FGEKK------------
SEQ ID NO:369
                 241                           273
```

FIGURE 7A

```
                          *          **  *  *** **              *   *        *    *
SEQ ID NO:178    MVKAT------------KF----NNMLYPREDKETRTLLYACQTCEHEEIATDTCVYKRVIRK
SEQ ID NO:180    MST--------------MKFCRECNNILYPKEDREQKVLLYACRNCDHQEVADNNCVYRNVVHH
SEQ ID NO:182    MAMSA------------LKFCGECSNMLYPREDKETHTLLYACNSCEHQEPATDTCVYKRVLRK
SEQ ID NO:186    MST--------------MKFCRECNNILYPKEDRDQKILLYACRNCDHQEVADNNCVYRNVVHH
SEQ ID NO:188    MSA--------------MKFCRECNNILYPKEDRDQKVLFACRNCDHQEVADNFCVYRNEIHH
SEQ ID NO:190    MSA--------------MKFCRECNNILYPKEDRDQKVLFACRNCDHQEVADNFCVYRNEIHH
SEQ ID NO:192    M--SA------------LKFCSKCDNMLYPQEDKEMHTLLYACSNCQHQEIATDTCVYKRVLRK
SEQ ID NO:194    MSA--------------MKFCRECNNILYPKEDRDQKVLLFACRNCDHQEVADNNCVYRNVVHH
SEQ ID NO:196    MSA--------------MKFCRECNNILYPKEDRDQKVLLFACRNCDHQEVADNNCVYRNVVHH
SEQ ID NO:370    MEPDGTYEPGFVGIRFCQECNMLYPKEDKENRILLYACRNCDYQQEADNSCIYVNKITH
                 1                                                             60

*   *     ****               **       *                *
SEQ ID NO:178    PGGEPKDVLKDAATDPSLPRTRSVRCYNCNHPEAAFFQAPT-KGEQAMTLYFICCNPS---
SEQ ID NO:180    SAGEFTQVLQDVAGDPTLPRTKSVRCSSSCGHGEAVFFQA-TARGEEGMTLFFVCCNPS---
SEQ ID NO:182    PAGEPKDILKDAATDPTLPRTRSIKCYNCGHPEAAFFQAPT-KGEKGLTLYFICCNPS---
SEQ ID NO:186    SAGEFTQVLQDVAGDPTLPRTKAVRCAVCGHGEAVFFQA-TARGEEGMTLFFVCCNPS---
SEQ ID NO:188    SVGERTQVLQDVAADPTLPRTKSVRCSQCNHGEAVFFQA-TARGEEGMTLFFVCCNPN---
SEQ ID NO:190    SVGERTQVLQDVAADPTLPRTKSVRCSQCNHGEAVFFQA-TARGEEGMTLFFVCCNPN---
SEQ ID NO:192    SADEPKDTLKDAAADASLPRTRSVKCYNCGYPEAAYFQAPT-KGELGLT----CTSSAAA
SEQ ID NO:194    SAGEFTQVLQDVAGDPTLPRTKEVRCAVCGHGEAVFFQA-TARGEEGMTLFFVCCNPS---
SEQ ID NO:196    SAGEFTQVLQDVAGDPTLPRTKEVRCAVCGHGEAVFFQA-TARGEEGMTLFFVCCNPS---
SEQ ID NO:370    EVDELTQIIADVSQDPTLPRTEDHPCQKCGHKEAVFFQSHSARAEDAMRLYYVCTAPH---
                 61                                                            120
```

FIGURE 7B

|  |  | * * * | * | * |  |
|---|---|---|---|---|---|
| SEQ ID NO:178 |  | -CGHRWR | - - - | D |  |
| SEQ ID NO:180 |  | -CGNRWRK | - - - |  |  |
| SEQ ID NO:182 |  | -CGHRWR | - - - | D |  |
| SEQ ID NO:186 |  | -CGHRWRE | - - - |  |  |
| SEQ ID NO:188 |  | -CGHRWER | - - - |  |  |
| SEQ ID NO:190 |  | -CGHRWRD | - - - |  |  |
| SEQ ID NO:192 | YCGHKWEGLTD |  |  |  |  |
| SEQ ID NO:194 |  | -CGHRWRNVV | - |  |  |
| SEQ ID NO:196 |  | -CGHRWRE | - - - |  |  |
| SEQ ID NO:370 |  | -CGHRWTE | - - - |  |  |
|  | 121 |  |  | 131 |  |

FIGURE 8A

```
                                                                             *
SEQ ID NO:200   ------------------------------------------------------------
SEQ ID NO:202   ------------------------------------------------------------
SEQ ID NO:204   ------------------------------------------------------------
SEQ ID NO:206   LTPFPIPTASIPIPISSI------------------------------------------
SEQ ID NO:208   TTPSSATPQLHPHPHRTISAHQERNTEKRKIAMAPRTSDKTMSPAAAA-TGLALGVGGVA
SEQ ID NO:212   VLTTHPNP--TSQNTHPVYQRSAPATCKPAAPMAPRAATVEKVAVAPP-TGLGLGVGG--
SEQ ID NO:214   ME--EAMRRLNGVA--PIIGPDSKGDGGLIANNPKRTSAVNKRA-------------
SEQ ID NO:216   HASYSSLSPLFCSPLRKNLNHQNQ---KHAPTMAPRDSRATAFAGPGPSPA---------
SEQ ID NO:218   ---------FFSLP----------------------------------------------
SEQ ID NO:220   ------------------------------------------------------------
SEQ ID NO:371   ME---GG-----------------------------------------------------
                1                                                           60

*  ****    *   **    *  **
SEQ ID NO:200   ------------------------------MAPRVA--DKSPLPPA-TGLGLGVGG---
SEQ ID NO:202   ------------------------------MAPRTSEKTMAPAAAAATGLALSVGGGG
SEQ ID NO:204   ------------------------------------------------PELGAGMRRGG
SEQ ID NO:206   ------------------------------------------------------------
SEQ ID NO:208   ------------------------------------------------------------
SEQ ID NO:212   ------------------------------------------------------LREDG
SEQ ID NO:214   ------------------------------MAPRDKPD---ATTAAANG----------
SEQ ID NO:216   ------------------------------MAPRAA--EKAPVSPP-TGLGLGLGG---
SEQ ID NO:218   ------------------------------------------------------------E
SEQ ID NO:220   ------------------------------MAPR-----EKTPAVKVNAGVK-------
SEQ ID NO:371   ****  ****    ****  ****     *   **** * ** *** ***      **

SEQ ID NO:200   GVGGVGMGPHYRGVRKRPWGRYAAEIRDPAKKS-RVWLGTYDTAEEAAKAYDSAAREFRG
SEQ ID NO:202   GAG----GPHYRGVRKRPWGRYAAEIRDPAKKS-RVWLGTYDTAEDAARAYDAAAREYRG
SEQ ID NO:204   AAEEDAEAARFRGVRKRPWGRYAAEIRDPAKKA-RVWLGTYDSAEDAARAYDAAARALRG
SEQ ID NO:206   GAAAVGTGQHFRGVRKRPWGRYAAEIRDPAKKS-RVWLGTFDTAEEAARAYDAAAREYRG
SEQ ID NO:208   GVG--AGGPHYRGVRKRPWGRYAAEIRDPAKKS-RVWLGTYDTAEEAARAYDAAAREFRG
SEQ ID NO:212   GGGGGGAMRYRGVRRRPWGRYAAEIRDPQSKE-RRWLGTFDTAEEAACAYDCAARAMRG
SEQ ID NO:214   ----HKEIRYRGVRKRPWGRYAAEIRDPGKKT-RVWLGTFDTAEEAARAYDTAAREFRG
SEQ ID NO:216   ----AKESRFRGVRKRPWGRYAAEIRDPGKKT-RVWLGTFDTPEEAARAYDSAARQFRG
SEQ ID NO:218   GVGVVAGGAHYRGVRKRPWGRYAAEIRDPAKKS-RVWLGTYDTAEEAARAYDTAAREFRG
SEQ ID NO:220   GSGGGGEPTKYRGVRRRPWGKFAAEIRDSSRHGVRMWLGTFDTAEEAAAAYDRSAYSMRG
SEQ ID NO:371   ------EVHFRGVRKRPWGRYAAEIRDPGKKS-RVWLGTFDTAEDAARAYDAAAREFRG
                61                                                          120
```

FIGURE 8B

```
                    *  **
SEQ ID NO:200       AKAKTNFPF--PSQCSVAS---------------GAAGSASSN----STVDSSGGGSGC-GIQAPM
SEQ ID NO:202       AKAKTNFPY--PS----CVP------LSAAGCRSSNSS--------TVESFSSD------AQAPM
SEQ ID NO:204       AKAKTNFPLSLPHAQPQLHHHHHHLTYPAAAVVAAR------PATSSLSSTVESFGTRPRP
SEQ ID NO:206       AKAKTNFPY--PN----GAP------AAGVNSGSSNSS--------TVESFGSD------VQAPM
SEQ ID NO:208       AKAKTNFPF--ASQSM--------------VGCGGSPSSN------STVDTGGGG------VQTPM
SEQ ID NO:212       LKARTNFVYPTSPQPSSATTEHLFPNENNNNNFHKHSLFNHHRNRHITGSNTCFDHPHSV
SEQ ID NO:214       AKAKTNFPT--PSELILNNN------I-----RSPSQS----STLDS-------SSPP
SEQ ID NO:216       AKAKTNFPF--HTDLVLPTA------VKGVARSPSEN----SIVET--------PIPA
SEQ ID NO:218       AKAKTNFPF--PSSSSSSP-------VAGAGGGGPSSD----STLDSSGGGSGG-CAQAPM
SEQ ID NO:220       RNAVLNFP-----------------------------------DRAHVYEAEARRQGQGS------
SEQ ID NO:371       PKAKTNFPF--PDSDDINSNNNNIVVVKNNNRSPSQS-----STVESSSRDRDSYSAAAAA
                                                                                    180

*           *   *                    *
SEQ ID NO:200       Q--AMPLPPALDL-----DLFHRAAAVNAVS--TGMRFPF------KG-----YPVACPTP--QQ
SEQ ID NO:202       Q--AMPLPPSLEL-----DLFHRAAAAATGTGAAAVRFPF------GS-----IPVT-----HP
SEQ ID NO:204       V--LPPRPPP--------------------------PPPIPDGDCRSDC----GSSASVV-------
SEQ ID NO:206       K--AMPIPPSLEL-----DLFHRAAAAAA-GAGGMRFPF------EG-----YPVS-----HP
SEQ ID NO:208       R--AMPLPPTLDL-----DLFHRAAAVTAVAG-TGVRFPF------RG-----YPVA-RPATHP
SEQ ID NO:212       DFSAPRNPSSLNMLLFRDLIHSNPSLLSSSSTQNFHDQFYNKSTFSSLPVSPSLAPPS
SEQ ID NO:214       S--PPP-P--LDL-----TLT---------------------PL----SVAAAVFPVA-----RP
SEQ ID NO:216       A--PLP-PEALDL-----SLS---------------------HY----SVG--FPMA-----RS
SEQ ID NO:218       Q--AIPLPPALDL-----DLFHRAAAVTAVAG-GGMRFPF------NG-----YPVAPRQPMHP
SEQ ID NO:220       -----------------SSSARQQNQQQ-------------------------
SEQ ID NO:371       T--AVADSSPLDL-----NL------APAGAGFAGSIRFPF-----QQPFAVFPGGMPAAKQA
                                                                                    240
```

FIGURE 8C

```
SEQ ID NO:200  YF-----------------------------------FYEQAAAAA------SGYRMLKVA---
SEQ ID NO:202  YY-----------------------------------FFGQAAAAAA----EAGCRVLKLA---
SEQ ID NO:204  -------------------------------------DDDCADAA----ASPSCR-LPFQ---
SEQ ID NO:206  YY-----------------------------------FFGQAAAAAA----ASGCRMLKIA---
SEQ ID NO:208  YF-----------------------------------FYEQAAAAAA----AEAGYRMMKLA---
SEQ ID NO:212  YSMNNSCGGSLSVKMNTFPTCGTNFAEKGDDGDGFFSRESSDSGLLEEIVNKFLPRTKPS
SEQ ID NO:214  VL-----------------------------------FFDAFA-------RADAMIAVS----
SEQ ID NO:216  LL-----------------------------------LYHSQQVNNN---RLRSDRLVVRD---
SEQ ID NO:218  YF-----------------------------------FYEQAAAAAA----AASGYRALKVA---
SEQ ID NO:220  -------------------------------------QQGQSGVIE----F------------
SEQ ID NO:371  LY-----------------------------------L-DAVLRASM---ASHGQFGFGYN---
               241                                                         300

*        *  ***
SEQ ID NO:200  ------------------------------PP-AVTVAAVAQSD-----------------
SEQ ID NO:202  ------------------------------PA-----VTVAQSD-----------------
SEQ ID NO:204  ------------------------------FDLNLPPGGGGGG------------------
SEQ ID NO:206  ------------------------------PA-PVTVAALAQSD-----------------
SEQ ID NO:208  ------------------------------PP---VTVAAVAQSD----------------
SEQ ID NO:212  KCETTFANPQEESLLLPPLVSESTLVSTGQQYYDDMKKGFPKNEGLGVFYSDQGFPMQQ
SEQ ID NO:214  ------------------------------RR-----ETCGFERPA----------------
SEQ ID NO:216  ------------------------------PKLNVGAGGVVQSD-----------------
SEQ ID NO:218  ------------------------------QP---VTVAAVARSD----------------
SEQ ID NO:220  ------------------------------------EYLDDDV------------------
SEQ ID NO:371  ------------------------------RP-A--AAAAGAQSD----------------
               301                                                         360
```

FIGURE 8D

```
SEQ ID NO:200  -SDSSSVVDHSPSPPA-VTAN----------K-VGFELDLNWPPPAE--N
SEQ ID NO:202  -SDCSSVVDLSPSPPAAVSAR----------KPAAFDLDLNCSPPTEAEA
SEQ ID NO:204  -GGFGCAYDDE--------------------ELRL-----TALRL
SEQ ID NO:206  -SDSSSIVDLAPSPPAAL-AK----------KAIAFDLDLNCPPPMEV--
SEQ ID NO:208  -SDSSSVVDLAPSPPA-VTAN----------KAAAFDLDLNRPPPVE--N
SEQ ID NO:212  FDTSNGFNSMAMENDQNIINNAENCVVEDVFQYQELLNAFAIRMQNA
SEQ ID NO:214  -ADFRRNDSDSDYN-----------------RRVLLDLDLNVPPLPEV-A
SEQ ID NO:216  -SDSSSQVINYSYHSVRPKQE----------KSLTLDLDLNFPP-PEV-A
SEQ ID NO:218  -SDSSSVVDLSPPPA-VTAH-----------KAVAFDLDLNRPPPSE--D
SEQ ID NO:220  -----LQSMLHDHDKS---------------------------NK
SEQ ID NO:371  -SDSSSVIDLNQNE-GDVAKN----------NGRGLVLDLNEPPPQEM-A
                361                                              407
```

**

FIGURE 9A

```
                    *                                                              *
SEQ ID NO:236    MAA-------------------------------------------------PPPQYYQAGHP---
SEQ ID NO:238    M---MQPPP-------PHQQQWAMAPP---------------------------------------
SEQ ID NO:240    MQPLHQPPMNGQHGPPPPQGSSGVPTASQQQAPPPSYYQQQQQQQGPPPQYYQQGPPPQPW
SEQ ID NO:242    M---MQQPP-------PQQPQP-GMALP------------------------PPPQTGGGQPPQ-W
SEQ ID NO:248    M---------------QAAAAANGAGDVQKPQQQPLVAGAPPPPPAAVVP--P-----HW
SEQ ID NO:250    M---MQQPP-------QPQP-GMALP--------------------------PPPQTGGGQPPQ-W
SEQ ID NO:252    MQ--------MAAAVAPTDAPASASAAAAPSRPHAHAAAAVAAASPHPHALHPHHHMPQPRW
SEQ ID NO:254    MQ--------MAATTTESQA-------AVPPQHPHAHPHAP------PQHAHPHHHMPQPRW
SEQ ID NO:258    M---MQPPP-------PPQ------WAMGPP----------------------PPPQYFQAG-P--
SEQ ID NO:268    M---MQ-AG-------PG-------GMAQQ-----------------------------ANQQY---AQ---
SEQ ID NO:270    M---------------QQSNGSDSTTTMEQS-------APPPPRQSPAVARP---Q----QW
SEQ ID NO:272    M---------------AQPSSNGDLNNNQQQGQVQQQQQGQ-WAAAAQPHQYQQ-----QW
SEQ ID NO:274    M---------------QQSNGSDSTTEQKA--------PPPRQSPAVARP---Q----QW
SEQ ID NO:276    M---MQQPG-------PGMAPP--TMGQQ-----------------------PPQQY-----QQP--
SEQ ID NO:278    MAS---------------------------------------------------------------
SEQ ID NO:280    M---------------AQPSSNGDLNNNQQ--GQVQQQQ---Q-WAAA-QPHQYQQ-----QW
SEQ ID NO:282    MV----------------------------------------------------------------
SEQ ID NO:372    M---------------NGGDMNQQQQQQQQQQQQQQQQQQQWMAM---QQYQQ-----QW
                 1                                                              60
```

FIGURE 9B

```
                                                                                      *           *                   *
SEQ ID NO:236  --------------------------------------------------------------------------PYHQP-----------
SEQ ID NO:238  ---P----------PPPPQFY-----QAGPPPAMWGQP----------PP-----QA-----------
SEQ ID NO:240  AQQQYAPPPPQYPPQMQQYAPPPQQYAPPPQQQYAAPPPQQQYAPPPQYAPP
SEQ ID NO:242  GAIP---------PPMTQQYGAPPP--QQPPAMWGQPPSQAHYGQAPP----HQPYYAAP
SEQ ID NO:248  VAMP-FAPPPGAAA------MVMQPHHMAPPPPQFAPTHFVPFHA--VAPPRAQS--VPA
SEQ ID NO:250  GAIP---------PPMTQQYGAPPP--QQPPAMWGQPPSQAHYGQAPP----PQPYYAAP
SEQ ID NO:252  VVIP-YPPPH----------HPMVAAP--PPPSLQFVK---HFTPPSS--VTP
SEQ ID NO:254  VVIP-YPPPP----------PMVAAP---PPPP-QFAK---HFAAGPP--PPP
SEQ ID NO:258  ---P----------PPPPQYF-----QGAHPPAAMWGQP----------PP-----PQA-----------
SEQ ID NO:268  --------------QQQQPYMMMPPQPQPPQ-MWATSA----------QPP-----SQS-----------
SEQ ID NO:270  VPMQ-Y---PAAAA-------MVM-PHHMLPPQ-HYAPPPYVPYHH----------QYA--A---
SEQ ID NO:272  MAMQ-Y---PATA--------MAMMQQQMLM-----Y-PQHYMPYAH--PHYPPPPP--PPP
SEQ ID NO:274  LPMQ-Y---PAAA--------MVM-PHHMLPPQ--HYAPPPYVPFHH--HHHHHQYA--APH
SEQ ID NO:276  ---P---------PQQQQPYVMMPPQAQAPQAMWAPSA----------QPP-----PQ------------
SEQ ID NO:278  --------------------------------------------YQQA--------------------
SEQ ID NO:280  MAMQ-Y---PATA--------MAMMQQQMMM-----Y-PQHYMPYAH--PHYPPPPP--PPP
SEQ ID NO:282  -----------------------------------------------A-------------------
SEQ ID NO:372  MAMQ-Y---PAAA--------MAMRNDRCMV------SNTCL-------------------------
               61                                                                                                    120
```

FIGURE 9C

```
                                                                                        *   *** *          *               *   **
SEQ ID NO:236  ------------------------------TSLEEVRTLWIGDLQYWTDENYL-YSCFAHTGE-VQSVKII
SEQ ID NO:238  -AAAPAPA---------GGGAGDEARTLWIGDLQYWMDENYL-YSCFSQAGE-VISVKII
SEQ ID NO:240  PQQYAQPPQYAQPPQYGTTPGSGEVRTLWIGDLQYWMDENYLHYNAFAPVAQQIASVKII
SEQ ID NO:242  PVPVQAPA---------APAAADEVRTLWIGDLQYWMDENYV-FGCFSNTGE-VQNVKLI
SEQ ID NO:248  AVALGSPAPHQPG---QE-----ENKSVWVGDLHYWMDENYLH-SCFGYTGE-VVAIKVI
SEQ ID NO:250  PV-----PA--------APAAADEVRTLWIGDLQYWMDDNYV-FGCFSNTGE-VQNVKLI
SEQ ID NO:252  ---------PPPTGSGGNGG-EDNRTIWVGDLQYWMDENYLH-SCFGSSGE-VVNIKVI
SEQ ID NO:254  QAGAGRRTPTPPSSGSGGNGC-EENKTIWVGDLQYWMDENYLH-NCFGPSGE-VVTIKVI
SEQ ID NO:258  -APPPAPA---------GGAAGDEVRTLWIGDLQFWMEENYL-YNCFSQAGE-LISAKII
SEQ ID NO:268  -VAPPQPT---------S---ADEVRTLWIGDLQYWMDENYL-YTCLAHTGE-VASVKVI
SEQ ID NO:270  ---------QPQHQ----HQNGSGGENKTIWIGDLHHWMDENYLH-RCFASTGE-ISSIKVI
SEQ ID NO:272  S-SHHHHHHKQAAA---SSDEIRTVWLGDLHHWMDENYLH-NCFAHTGE-VVSAKVI
SEQ ID NO:274  VPNQHQQQQHHH---HQNGSGGENKTIWIGDLHHWMDENYLH-RCFASTGE-ISSIKVI
SEQ ID NO:276  ----QQPA---------S---ADEVRTLWIGDLQYWMDENYL-YTCFAHTGE-VTSVKVI
SEQ ID NO:278  ---------STIEEVRTLWIGDLQYWVDEGYL-SHCFGHTGE-VISIKII
SEQ ID NO:280  PQSSHHHHHKQAAAAAAASSDEIRTVWLGDLHHWMDENYLH-NCFAHTGE-VVSAKVI
SEQ ID NO:282  ---------TAIEEVRTLWIGDLQYWVDESYL-SQCFAHSGE-VVSIKII
SEQ ID NO:372  -QQHQQQQKMQQSPTQIQSSSEDNKTIWIGDLQQWMDESYLH-SCFSQAGE-VISVKII
               121                                                                  180
```

FIGURE 9D

```
                    *      *** **  **  *       **        *    *  *     *    ****      *
SEQ ID NO:236   RNKVTSLPEGYGFIEFVSHEAAEKILQTYNGTQMPGTEHTFRLNWASFSSGERRP-DPGS
SEQ ID NO:238   RNKQTGQPEGYGFIEFSNHAVAEQVLQNYNGQMMPNVNQPFKLNWATSGAGEK-RGDDGS
SEQ ID NO:240   RNKQTGHSEGYGFIEFYSQAAAEHTLMNFNGQMMPNIEMAFKLNWASASTGDK-RGDNGS
SEQ ID NO:242   RDKNSGQLQGYGFVEFTSRAAAERVLQTYNGQMMPNVDLTFRLNWA--SAGEK--RDDTP
SEQ ID NO:248   RNKQTGQSEGYGFVEFYSHAAAEKVLEGFSGHIMPNTDQPFRLNWASFSMGD-RRSDSAS
SEQ ID NO:250   RDKNSGQLQGYGFVEFTSRAAAERVLQTYNGQMMPNVDLTFRLNWA--SAGEK--RDDTP
SEQ ID NO:252   RNRHSGVSEGYGFIEFYTHVSAEKALQNFSGHVMPNTDRAFKLNWASYSMGEKRS-EISS
SEQ ID NO:254   RNRQTGQSEGYGFVEFFSHASAEKALQNFTGHVMPNTDRPFKLNWASYSMGEKRS-EVAS
SEQ ID NO:258   RNKQTGQPEGYGFIEFGSHAIAEQVLQGYNGQMMPNGNQVFKLNWATSGAGEK-RGDDGS
SEQ ID NO:268   RNKQTSQSEGYGFIEFTSRAGAERVLQTYNGTIMPNGGQNFRLNWATLSAGER-RHDDSP
SEQ ID NO:270   RNKQTGLSEGYGFVEFYSHATAEKVLQNYAGILMPNAEQPFRLNWATFSTGD-KGSDNVP
SEQ ID NO:272   RNKQTGQSEGYGFVEFYSRGTAEKVLQNYNGTMMPNTDQAFRLNWATFSAGEGRSSDATS
SEQ ID NO:274   RNKQTGLSEGYGFVEFYSHATAEKVLQNYAGILMPNTEQPFRLNWATFSTGD-KGSDNVP
SEQ ID NO:276   RNKQTSQSEGYGFIEFNSRAGAERILQTYNGAIMPNGGQSFRLNWATFSAGERSRHDDSP
SEQ ID NO:278   RNKLTGQPEGYGFVEFVSHAAAERVLQTYNGTQMPATDQTFRLNWASFGIGERRP-DAAP
SEQ ID NO:280   RNKQTGQSEGYGFVEFYSRATAEKVLQNYNGTMMPNTDQAFRLNWATFSAGERRSSDATS
SEQ ID NO:282   RNKLTGQPEGYGFVEFVSHASAEAFLRTFNGAQMPGTDQTFRLNWASFG-----DSGP
SEQ ID NO:372   RNKQTGQSERYGFVEFNTHAAAEKVLQSYNGTMMPNAEQPFRLNWAGFSTGEKRA-ETGS
                181                                                          240
```

FIGURE 9E

```
         ********* ****   *      *    **    *     *     *   *    ******  *
SEQ ID NO:236   DHSIFVGDLALDVTDYLLQETFRVNYSSVRGAKVVTDPNTGRSKGYGFVKFADENEKNRA
SEQ ID NO:238   DYTIFVGDLASDVTDFILQDTFKSRYPSVKGAKVVFDRTTGRSKGYGFVKFADSDEQTRA
SEQ ID NO:240   DHAIFVGDLAPDVTDSMLEDVFRANYPSVRGAKVVDRITGRPKGYGFVHFGDLNEQARA
SEQ ID NO:242   EYTIFVGDLAADVTDYLLQETFRVHYPSVKGAKVVTDKLTMRTKGYGFVKFGDPTEQARA
SEQ ID NO:248   DHSIFVGDLASDVNDATLLEAFSSRYSSVKGAKVVIDANTGRSKGYGFVRFGDDSEKTQA
SEQ ID NO:250   DYTIFVGDLAADVTDYLLQETFRVHYPSVKGAKVVTDKLTMRTKGYGFVKFGDPTEQARA
SEQ ID NO:252   DHSIFVGDLAVDVTDAMLLELFSNKYRSVKGAKVIIDANTGRSRGYGFVRFGDDNDKIHA
SEQ ID NO:254   DHSIFVGDLAADVTDEMLLELFSSKYRSVKGAKVIIDANTGRSRGYGFVRFGDDNDKSHA
SEQ ID NO:258   DYTIFVGDLASDVTDLILQDTFKAHYQSVKGAKVVFDRSTGRSKGYGFVKFGDLDEQTRA
SEQ ID NO:268   DHTIFVGDLAADVTDYLLQETFRARYPSIKGAKVVIDRLTGRTKGYGFVRFGDESEQVRA
SEQ ID NO:270   DLSIFVGDLAADVTDSLLHETFASVYPSVKAAKVVFDANTGRSKGYGFVRFGDDNERTQA
SEQ ID NO:272   DLSIFVGDLAIDVTDAMLQDTFAGRYSSIKGAKVVIDSNTGRSKGYGFVRFGDENERTRA
SEQ ID NO:274   DLSIFVGDLAADVTDSLLHETFASVYPSVKAAKVVFDANTGRSKGYGFVRFGDDNQRTQA
SEQ ID NO:276   DYTIFVGDLAADVTDYLLQETFRARYNSVKGAKVVIDRLTGRTKGYGFVRFSDESEQVRA
SEQ ID NO:278   EHSIFVGDLAPDVTDYLLQETFRAHYPSVRGAKVVTDPNTARSKGYGFVKFSDENERNRA
SEQ ID NO:280   DLSIFVGDLAIDVTDAMLQETFAGRYSSIKGAKVVIDSNTGRSKGYGFVRFGDENERTRA
SEQ ID NO:282   DHSIFVGDLAPDVTDFILQETFRAHYPSVKGSKVVTDPATGRSKGYGFVKFADEAQRNRA
SEQ ID NO:372   DFSIFVGDLASDVTDTMLRDTFASRYPSLKGAKVVVDANTGHSKGYGFVRFGDESERSRA
                241                                                        300
```

FIGURE 9F

```
            *   *   *   *    *    *                                              *
SEQ ID NO:236   MTEMNGVYCSTRPMRISAAIPKKSTGS-QLQYSA-AKAVYPATAYAMPQLQAVLPDSDPT
SEQ ID NO:238   MTEMNGQYCSSRAMRLGPASNKKNTGG-PQ--PSSAIY--------QNTQ--GTDSDSDPN
SEQ ID NO:240   MTEMNGMMLSTRKMRIGAAASKKNTDA-QQTYATNGAY--------QSS--QGNCSENDPN
SEQ ID NO:242   MTEMNGMPCSSRPMRIGPAASRKNTGG-VV--QERV----------------PNSQGAQSENDPN
SEQ ID NO:248   MTEMNGVYCSSRPMRIGPATPRKSSGT-----------------SGSNGSAA----RSDGGDLT
SEQ ID NO:250   MTEMNGMPCSSRPMRIGPAASRKNAGG-VV--QERV----------------PNSQGAQSENDPN
SEQ ID NO:252   MTEMNGVYCSTRPIRVGPATPRRSQG-----------------------------DSGTSPPRQSHVDST
SEQ ID NO:254   MSEMNGVYCSTRPIRIGPATPRRSSG-----------------------------DSGSSTPGHSDGDSS
SEQ ID NO:258   MTEMNGQYCSSRPMRIGPASNKKNIGG-QQ--QPSATY--------QNTQ--GTDSDSDPN
SEQ ID NO:268   MTEMQGVLCSTRPMRIGPASNKNPSTQ-SQ--PKASY--------QN--PQGAQNEHDPN
SEQ ID NO:270   MTQMNGVYCSSRPIRIGVATPKKTYGF-QQQYSSQAVVLAGGHSANGAVAQGSHSEGDIN
SEQ ID NO:272   MTEMNGVYCSSRPMRIGAATPRKSSGH-QQ-------------GGLSNGTA------NQSEADST
SEQ ID NO:274   MTQMNGVYCSSRPMRIGAATPRKSSGH-QQ-------------GGQSNGTA------NQSEADST
SEQ ID NO:276   MTEMNGVYCSTRPMRIGPASNKTPTTQ-SQ--PKASY--------QNSQPQGSQNENDPN
SEQ ID NO:278   MTEMNGVYCSTRPMRISAATPKKTTGAYAAPAAPVPKPVYPVPAYTSPVVQPPDYDVN
SEQ ID NO:280   MTEMNGVYCSTRPMRIGVATPKKTYGY-QQQYSSQAVLLAGGHAANGAVAQGSHSEGDLN
SEQ ID NO:282   MTEMNGVYCSTRPMRISAATPKKNAS-FQHQYAP-PKAMYQFPAYTAPVSTV-APENDVN
SEQ ID NO:372   MTEMNGVYCSSRAMRIGVATPKKP-SA-QQQYSSQAVILSGGYASNGAATHGSQSDGDAS
301                                                                                    360
```

FIGURE 9G

```
              *  *            *  *        *                 *        *  ***         *      *  ***    *  **  *     *    *   *       *
SEQ ID NO:236 NTTIFIGNLDPNVIEDELRQICVQFGELIYKIPVGKGCGFVQYASRASAEEAVQRLHGT
SEQ ID NO:238 NTTVFVGGLDPSVTDELLKQTFSPYGELLYKIPVGKRCGFVQYSNRASAEEAIRVLNGS
SEQ ID NO:240 NTTVFVGGLDSNVDEEYLRQIFTPYGEISYVKIPVGKHCGFVQFTSRSCAEEAIQMLNGS
SEQ ID NO:242 NTTVFVGGLDPNVTEDTLKQVFSPYGEVHVKIPVGKRCGFVQFVTRPSAEQALLMLQGA
SEQ ID NO:248 NTTVFVGGLDPNVSEEDLRQTFSQYGEISSVKIPIGKQCGFVQFAQRKNAEDALQGLNGS
SEQ ID NO:250 NTTIFVGGLDPNVTEDVLKQAFSPYGEVIHVKIPVGKRCGFVQFVTRPSAEQALLMLQGA
SEQ ID NO:252 NRTVYVGGLDPNVSEDELRKAFAKYGDLASVKIPFGKQCGFVQCGFVQFVNRVDAEEALHGLNGS
SEQ ID NO:254 NRTVYVGGLDPNVSEDELRKAFAKY-DLASVKIPLGKQCGFVQFVSRTDAEEALQGLNGS
SEQ ID NO:258 NTTVFVGGLDPSVTDEVLKQAFSPYGELVYVKIPVGKRCGFVQYSNRASAEEAIRMLNGS
SEQ ID NO:268 NTTIFVGNLDPNVTDDHLRQVFEGHYGELVHVKIPAGKRCGFVQFADRSCAEEALRVLNGT
SEQ ID NO:270 NTTIFVGGLDPNVSDEDLRQPFSQYGEIVSVKIPVGKGCGFVQFANRNNAEEEALQKLNGT
SEQ ID NO:272 NTTIFVGGLDSDTSDEDLRQPFLQFGEGVVSVKIPVGKGCGFVQFADRKNAEEAIQGLNGT
SEQ ID NO:274 NTTIFVGGLDPNVSDEDLRQPFSQYGEIVSVKIPVGKCCGFVQFANRNNAEEALQKLNGT
SEQ ID NO:276 NTTIFVGNLDPNVTDDHLRQVFSQYGELVHVKIPAGKRCGFVQFADRSCAEEALRVLNGT
SEQ ID NO:278 NTTIFVGGLDSDTSDEDLRQPFLQFGEGVVSVKIPVGKGFGFVQFGTRASAEEAIQKMQGK
SEQ ID NO:280 NTTIFVGNLDLNVSEEELKQNSLQFGEIVSVKIQPGKGFVQFGKCGFVQFADRKNAEEAIHALNGT
SEQ ID NO:282 NTTVCIGNLDLNVTEEELKQAFVQFGDIVLVKIYAGKGYGYVQFGTRASAEDAIQRMQGK
SEQ ID NO:372 NTTIFVGGLDSDVTDEELRQSFNQFGEVVSVKIPAGKGCGFVQFSDRSSAQEAIQKLSGA
              361                                                       420
```

FIGURE 9H

```
                *  *                 *                           **                         **           **
SEQ ID NO:236   MIGQQAVRLSWGRSPASKQ----DSSAVWSQQADPNQWANTYYGYG---YDAYGY------
SEQ ID NO:238   QLGGQSIRLSWGRNPANKQ--PQQEQSQWSGG-----------GYYGYP-QGYDPYGYAR-PP
SEQ ID NO:240   QIGGQKARLSWGRSTQNRQASQHDANSQYNGN-----------NYYRYQQPGNEGYSYGA-PN
SEQ ID NO:242   LIGAQNVRLSWGRSLSNKQAQPQQESNQWGAAA--G--AGGYYGGYGQGYEAYGSGY-AQ
SEQ ID NO:248   TIGKQNVRLSWGRNPANKQFRGDNG-NQWNNG--------GMYYA-APPFYNGYGYPAAAP
SEQ ID NO:250   LIGAQNVRLSWGRSLSNKQTQPQQESMQWGAGAPAG--VGDYYGGYGQGYEAYGSGY-AQ
SEQ ID NO:252   TIGKQAVRLSWGRSPASKQSRGDSG-HRRNGNCN---------GMYYG-TP-FYGGYGYAS--P
SEQ ID NO:254   LIGKQAVRLSWVRSPSHKQSRGDSV-NRRN-----------NMYYG-TP-FYGGYGYAS--P
SEQ ID NO:258   QLGGQSIRLSWGRSPGNKQ--PQQDQNQWNAG-----------YYGYPPQGYDPYGYVR-PP
SEQ ID NO:268   LLGGQNVRLSWGRSPSNKQ--AQPDANQWNG-----SG---GGYYGYAQGGYENYGYAP-A-
SEQ ID NO:270   TIGKQTVRLSWGRNPANKQFRMDFG-SPW---T----------GAYYG-AP-MYDGYGY-ALPP
SEQ ID NO:272   VIGKQTVRLSWGRSPGNKHWRSDSN-G----GH---------YG-GHQGYGGHGF-AVRQ
SEQ ID NO:274   SIGKQTVRLSWGRNPANKQFRMDFG-NPW---T----------GAYYG-AP-MYDGYGY-ALTP
SEQ ID NO:276   LLGGQNVRLSWGRSPSNKQ--AQADPNQWNGGAGSG---GGYYGYAAQGYENYGYAP-AA
SEQ ID NO:278   MIGQQVVRISWGRTLTARQ----DLPGGWGPQMDPNQWS-AYYGYG-QGYEAYAYG---P
SEQ ID NO:280   VIGKQTV--------------------------------------------------------
SEQ ID NO:282   VIGQQVIQISWGSTLTARQ----DVPGGWGAQMDPSQWS-AYYGYG-QGYESYAYG---A
SEQ ID NO:372   IIGKQAVRLSWGRTA-NKQMRADSG-SQWNGG-----------YN-GRQNYGGYGY-GASQ
                421                                                           480
```

FIGURE 9I

```
                          *           *   * ** *** * **    *********
SEQ ID NO:236   AQDPS-YAYGAYAGYSQYPQQVEGTVDATSVAGSHPGMEQKEEPYDPMNIPDVDKLNASY
SEQ ID NO:238   -QDPAMYAYAAYPGYGNYQQ-QPPQQPPPQ------------------------------
SEQ ID NO:240   AQDPSIQNYYGYPGYGNYEQQSTQEQQQQQPP---PAQEQ--------------------
SEQ ID NO:242   PQDPNMYGYGAYGGYPNYQQQPAAQQQQQQ------------------------------
SEQ ID NO:248   FPDPGMYAAPA----YGAYPF-YG-NQQQV------------------------------
SEQ ID NO:250   PQDPNMYGYGAYVGYPNYQQQPAAQQPQQQ------------------------------
SEQ ID NO:252   IPHPNMYAAA----YEAYPY-YG-NQQLV-------------------------------
SEQ ID NO:254   VPHPNMYAAA----YGTYPL-YG-NQQLV-------------------------------
SEQ ID NO:258   -QDPAMYAYAAYPGYGNYQQ-PAPQQPP-Q------------------------------
SEQ ID NO:268   GQDPNMYG---SYPGYANYQP-PQQQQIGY------------------------------
SEQ ID NO:270   RHDPSIYAA-A---YGAYPL-YGGHQQQV-------------------------------
SEQ ID NO:272   NQDIAMQPAAA-I--------QGA------------------------------------
SEQ ID NO:274   RHDPSIYAA-A---YGAYPL-YGGHQQQV-------------------------------
SEQ ID NO:276   GQDPNMYG---SYPGYPGYQP-PQQQQQIGY-----------------------------
SEQ ID NO:278   AHDPSLYAYGAYPGYAQYPQQVEGAQDLSGM--SVPTMEQREELYDPLAMPDVDKLNAAY
SEQ ID NO:280   ------------------------------------------------------------
SEQ ID NO:282   THDPSLYAYGAYAGYAQYPQNVEGAQDMSAV--SMP---MEELYDPLAMPDVDKLNAAY
SEQ ID NO:372   NQDSGMYATGA--AAYGASSNGYGNHQQPV------------------------------
                481                                                          540
```

FIGURE 9J

```
                        *  ******  *
SEQ ID NO:236    MAVHGRAMLGRSLWLKTNPLP-QPT
SEQ ID NO:238    --------------------- -Q-
SEQ ID NO:240    ------PPPAPQ------------
SEQ ID NO:242    --------------------- -Q-
SEQ ID NO:248    --------------------- -S-
SEQ ID NO:250    --------------------- -Q-
SEQ ID NO:252    --------------------- -S-
SEQ ID NO:254    --------------------- -S-
SEQ ID NO:258    --------------------- -Q-
SEQ ID NO:268    --------------------- -S-
SEQ ID NO:270    --------------------- -S-
SEQ ID NO:272    --------------------- -S-
SEQ ID NO:274    --------------------- -S-
SEQ ID NO:276    --------------------- -S-
SEQ ID NO:278    LSVHGSAILGRSLWQKTCSSSLQQA
SEQ ID NO:280    --------------------- -Q-
SEQ ID NO:282    LSIHGSSILGRSLWQRT-SQSLQQA
SEQ ID NO:372    --------------------- -S-
                 541                   565
```

FIGURE 10A

```
                *          *    **  ** *** ***     *  ***** *    * **    **
SEQ ID NO:292   MASSNVST-VYISVIDDVISKVREDFITYGV-GDAVLNELQALWEMKMLHCGAISGNIDR
SEQ ID NO:294   MASSNVST-VYISVIDDVISKVREDFITYGV-GDAVLNELQALWEMKMLHCGAISGNIER
SEQ ID NO:296   MASSNVST-VYISVIDDVISKVRDDFISYGV-GDAVLNELQALWEMKMLHCGAISGTIDR
SEQ ID NO:298   MAASTT-SQVYIEDVMKVRDEFVNNGGPGEEVLKELQAMWESKMMQAGAVLGSHRK
SEQ ID NO:300   MAASST-SQVYIQVIDDVMIKVRDEFVNNGGPGDEVLKELQSIWESKMLQAGAIVGPIER
SEQ ID NO:373   MGTTTTTSAVYIHVIEDVVNKVREEFINNGGPGESVLSELQGIWETKMMQAGVLNGPIER
                1                                                          60

*         *      ******   *****   ***************  ******
SEQ ID NO:292   TKAAAASVGGTTG--TTPPVHDLNVPYEATSEEYATPTADMLFPPTPLQTPIQTPLPGT-
SEQ ID NO:294   TKAAAASAGGTSG--TTPPVHDLNVPYEATSEEYATPTADMLFPPTPLQTPIQTPLPGT-
SEQ ID NO:296   SKAAPAPSAGTPGAGTTPPVHDLNVPYEATSEEYATPTADMLFPPTPLQTPIQTPLPGT-
SEQ ID NO:298   ASAAKATPGGP-----ITPVHDLNVPYEGT-EEYETPTADMLFPPTPLQTPIQTPLPGTG
SEQ ID NO:300   SGAPKPTPGGP-----ITPVHDLNMPYEGT-EEYETPTAEMLFPPTPLQTPIQTPLPGTV
SEQ ID NO:373   SSAQKPTPGGP-----LT--HDLNVPYEGT-EEYETPTAEMLFPPTPLPTPLPTPLPGTA
                61                                                        120

*        *******                    *                *
SEQ ID NO:292   -DTAMYNIPTGPSDYAPSPISDVRNGMAINGADPTAGHPSPYMPPPSPWMNQ---RPLGV
SEQ ID NO:294   -DTGMYNIPTGPSDYAPSPISDIRNGMTINGADPKAGRPSPYMPPPSPWMNQ---RPLGV
SEQ ID NO:296   -DAGMYNIPTGPSDYAPSPISDVRNGMAMNGADPKTGRPSPYMPPPSPWMTQ---RPLGV
SEQ ID NO:298   DNS-TYNIPTGANDY----PSSGNDTG---GNADGKGARPAPYMQPSSPWM----NQRPPL
SEQ ID NO:300   DNS-MYNIPTGPSDY----PSAGNEPG---ENNEIKGGRPGPYMQPP-PWTSQNQNQRAPL
SEQ ID NO:373   DNSSMYNIPTGSSDY----PTPGTENG---VNIDVK-ARPSPYMPPPSPWTN-----PRL
                121                                                       180
```

FIGURE 10B

```
                    *******  *           *          *    *      *****  *
SEQ ID NO:292       DVNVAYVEGREDPDRGVQPQPLTQDFLMMSSGKRKRDEYPGQLPSGSFVPQQDGSADQI-
SEQ ID NO:294       DVNVAYVEGREDPDRGVQPQPLTQDFLMMSSGKRKRDEYPGQLPSGSFVPQQDGSADQI-
SEQ ID NO:296       DVNVAYVENREDPDRTGQPPQLTKDFLMMSSGKRKRDEYPGQLPSGSFVPQQDGSADQI-
SEQ ID NO:298       DVNVAYVEGRDEADKGTSNQPLTQDFFTRTSGKRKHNDLTSQYNVGGYIPQQDGAGDAAH
SEQ ID NO:300       DVNVAYVEGRDAAERGASNQPLTQDFF-MSSGKRKRDEIASQYNAGGYIPQQDGAGDADS
SEQ ID NO:373       DVNVAYVDGRDEPERGNSNQQFTQDLFVPSSGKRKRDDSSGHYQNGGSIPQQDGAGDAIP
                                                                                240
                            *       * * *      ***  ***           *    *    *
SEQ ID NO:292       -VEFVVSKENANQLWSSIGNKLETPTKT--------ITPVIPQRDG-IQDNYNDQ------
SEQ ID NO:294       -VEFVVSKENANQHWSSIINKLETPTKT--------VTPVIPQCDG-IQDDYNDQ------
SEQ ID NO:296       -VEFVVSKDNAQQLWSSIVNKQGTATKESSTKETIIAPTIPQRDG-M-DDYNDP-------
SEQ ID NO:298       GV-FEIEVSGGG---ISINSHHTISKEKMSADLERSTSRIPQLDGPIP--YDDDVLSTPN
SEQ ID NO:300       QI-FEIEVYGGG---ISIDAGHSTSNGKMPAHSDRPASQIPQFDGPIP--YDDDVVSTPN
SEQ ID NO:373       EANFECDAF-------RITSIGDRKVPRDFFSSSSKIPQVDGPMPDPYDE-MLSTPN
                    241                                                          300
                                            *                 **       *
SEQ ID NO:292       -FFFPGVPTEDYNTPGESAEYRAPTPAVGTPKQRNDAGDD-DNDDDDDEPPLNEDDEE-
SEQ ID NO:294       -FFFPGVPTEDYNTPGESAEYRAPTPAVGTPKPRNDAGDNDDDDDDEEPPLNEDDDDDD
SEQ ID NO:296       -FYFQGVPTEDYNTPGESSEYRAPTPAVGTPKPRNDVGDD------DEPPLNEDDDDDD
SEQ ID NO:298       IYNYGEVFSEDYNISNTPA---PPEVPASTPALLAQNEVGNDFDDDDDEPPLNEEDDDD
SEQ ID NO:300       MYNYG-VFNEDYNIANTPA---SSDVPASTPAPVAQNEVDEE--DDDDDEPLNENDDDDD
SEQ ID NO:373       IYSYQGP-SEEFNEARTPA---PNEIQTSTPVAVQNDII------EDDEELLNEDDDDDE
                    301                                                          360
```

FIGURE 10C

```
          *** * * **** ********** **** ***** ******** **** ***** *****    *  *      ******
SEQ ID NO:292  -LDDLEQGEDEPNTQHLVLAQFDKVSRTKNRWKCTLKDGIMHLNGRDVLFNKATGEFDF
SEQ ID NO:294  DLDDLEEGEDEPNTQHLVLAQFDKVTRTKNRWKCTLKDGIMHLNGRDVLFNKATGEFDF
SEQ ID NO:296  ELDDLEQGEDEPNTQHLVLAQFDKVTRTKNRWKCTLKDGIMHLNGRDVLFNKATGEFDF
SEQ ID NO:298  -LDDMEQGDDQ-NTHHLVLAQFDKVLAQFDKVARTKSRWKCTLKDGIMHINNKDILFNKATGEFEF
SEQ ID NO:300  -LDDLDQGEDQ-NTHHLVLAQFDKVTRTKSRWKCTLKDGIMHINNKDILFNKATGEFEF
SEQ ID NO:373  -LDDLESGEDM-NTQHLVLAQFDKVTRTKSRWKCSLKDGIMHINDKDILFNKAAGEFDF
               361                                                       419
```

FIGURE 11

```
                    *********** *** ***  *   *  ***********  *** ***  *
SEQ ID NO:304       MATFELYRRSTIGTCLTETLDELVSSGAVSPELAIQVLVQFDKSMTEALEMQVKSKVSVK
SEQ ID NO:306       MATFELYRRSTIGMCLTETLDEMVSNGTLSPELAIQVLVQFDKSMTDALENQVKSKVTVK
SEQ ID NO:308       MATFELYRRSTIGMCLTDTLDDMVSSGALSPELAIQVLVQFDKSMTSALEHQVKSKVTVK
SEQ ID NO:310       MATFELYRRSTIGMCLTETLDEMVSSGTLSPELAIQVLVQFDKSMTEALENQVKSKVSIK
SEQ ID NO:314       MATFELYRRSTIGMCLTETLDEMVQNGTLSPELAIQVLVQFDKSMTEALETQVKSKVSIK
SEQ ID NO:316       MATFELYRRSTIGMCLTETLDEMVSSGTLSPELAIQVLVQFDKSMTDALETQVKSKVTVK
SEQ ID NO:374       MATFELYRRSTIGMCLTETLDEMVQSGTLSPELAIQVLVQFDKSMTEALESQVKTKVSIK
                    1                                                          60

*********** ************  * *   *       * ************
SEQ ID NO:304       GHLHTYRFCDNVWTFILTDATFKSEEIQETLGRVKIVACDSKLLQPQHP
SEQ ID NO:306       GHLHTYRFCDNVWTFILTDASFKNEEATEQVGKVKIVACDSKLLG---Q
SEQ ID NO:308       GHLHTYRFCDNVWTFILTDAIFKNEEITETINKVKIVACDSKLLETKEE
SEQ ID NO:310       GHLHTYRFCDNVWTFILTEASFKNEETTEQVGKVKIVACDSKLLS---Q
SEQ ID NO:314       GHLHTYRFCDNVWTFILQDALFKSEDSQEIVGRVKIVACDSKLLT---Q
SEQ ID NO:316       GHLHTYRFCDNVWTFILTDAQFKNEETTEQVGKVKIVACDSKLLS---Q
SEQ ID NO:374       GHLHTYRFCDNVWTFILQDAMFKSDDRQENVSRVKIVACDSKLLT---Q
                    61                                                109
```

FIGURE 12A

```
              *  ***** *****        *      **     ***         **   **
SEQ ID NO:320 MSGPLDRFARPCFEGFVHNDERKESRSD-ADNSEGDKKTKIGSFKKKAINAGNKFRHSLR
SEQ ID NO:324 MS----------VSHAEDIEISLCDGNSEDERRRRKIGSLRRKAI-----HALK
SEQ ID NO:334 MSGPLDRFARPCFEGFTHNDEKKEIRSD-ADNSEGEKKTKIGSFKKAINAGNKFRHSLR
SEQ ID NO:340 MSGPLDRFARPCFEGFSGSDEKKERRSDFEN-SEDERRTRIGSLKKKALNASSKFKHTLR
SEQ ID NO:352 MSTNL------CFEGM---DERRERKLSFENNSEDDRWAKIGSLKKKALFASTKFRHSFK
SEQ ID NO:375 MSGPVDRFAIPCFEGILSSDEKKERKSDFEN-SEDERRTRIGSLKKKAINASTKFKHSLK
              1                                                          60

**  ***** *****    *  *    **    **  ****  *** ****** **
SEQ ID NO:320 RR-SKKKTERG--DS---IKDIRDVKELQDVETFRQCLIDEDLLPPQHDYYHMMLRFLKA
SEQ ID NO:324 KR-GRRRVDFRFPPAAISIEDVRDAEEERAVASFRDRLAAHRLLPDKHDDYHMMLRFLKA
SEQ ID NO:334 RR-SKKKNEPR--GS---IEDIRDVQDLQAVDAFRQCLVDEDLLPQQHDDYHTMLRFLKA
SEQ ID NO:340 KKSSRRKSDGR--VSSVSIEDVRDFEELQAVDAFRQSLIMDELLPEAFDYHMMLRFLKA
SEQ ID NO:352 KKRSR-KIDSR--SNSLSIEDVRDVKDLQAVDAFRQALVLDNMLPPIHDDYHMLLRFLKA
SEQ ID NO:375 KK--RRKSDVR--VSSVSIEDVRDVEELQAVDEFRQALVMEELLPHKHDDYHMMLRFLKA
              61                                                         120

***    *  **     ****   *    ** * **   *  *   ********
SEQ ID NO:320 RKFEVEKAKSMWSDMINWRKEFGVDKI-EEFDYTELDEVTEYYPQFYHGVDKEGRPVYIE
SEQ ID NO:324 RKFEADKAMQMWSEMLKWRKEFGTDTILEDFDFAELDDVLRYYPQGYHGVDREGRPVYIE
SEQ ID NO:334 RKDVEKAKSMWSDMLKWRKEFGADNI-EEFDYTEADEVMKYYPQFYHGVDKEGRPIYIE
SEQ ID NO:340 RKFDIEKAKHMWTDMLQWRKEFGADTIVQDFEFEKELDEVVKYYPHGHGVDKEGRPVYIE
SEQ ID NO:352 RKFDIEKAKHMWANMIQWRKEYGTDTIMEDFEFKELNEVLKYYPHGYHGVDREGRPVYIE
SEQ ID NO:375 RKFDIEKAKHMWADMIQWRKEFGTDTIIQDFQFEEIDEVLKYYPHGYHSVDKEGRPVYIE
              121                                                        180
```

FIGURE 12B

```
                  *    *  *** *     *       *    ****         ***  *       ***  *********
SEQ ID NO:320     LVGKVDANKLIQVTTLXRYVKYHVKEFXKCFQMKFPACTIAAKNHIDSSTTILDVQGVGF
SEQ ID NO:324     RLGKVDPNKLMQITSVDRYIKYHVQEFERAFRERFPACTLAAKRHIDSTTILDVQGVGF
SEQ ID NO:334     LIGKVDANKLMQVTTIERYVKYHVKEFERCFQMRFPACSIAAKRPIDSSTTILDVQGVGL
SEQ ID NO:340     RLGKVDPNKLMQVTTLDRYVKYHVQEFEKAFAIKFPACSIAAKRHIDSSTTILDVHGVGL
SEQ ID NO:352     RLGKVDPNRLMQVTTLERYLRYHVQGFEKTFAVKFPACSIAAKRHIDSSTTILDVQGVGF
SEQ ID NO:375     RLGKVDPNKLMQVTTLDRYIRYHVKEFERSFMLKFPACTIAAKKYIDSSTTILDVQGVGL
                                                                                  240
                    *  *  *****  *    ******      *   ****  *     *******
SEQ ID NO:320     KNFSKSARELITRLQKIDSDNYPETLCRMYIINAGQGFKMLWSTIKSFLDPKTASKIH--
SEQ ID NO:324     KNFSRTARELVNRMQKIDSDYYPETLHQMFVVNAGSGFKWIWNSVKGFLDPKTSSKIH--
SEQ ID NO:334     KNFSKAARDLITRLQKIDNDNYPETLRRMYIINAGQGFKMLWSTVKSFLDPKTASKIH--
SEQ ID NO:340     KNFTKSARELITRLQKIDGDNYPETLCQMFIINAGPGFRLLWNTVKSFLDPKTTSKIH--
SEQ ID NO:352     KNLTKSARELITRLQKIDGDYYPETLCQMFIINAGPGFKMLWNTVKTFLDPKTTSKSH--
SEQ ID NO:375     KNFTKSARELITRLQKIDGDNYPETLHQMFIINAGPGFRLLWSTVKSFLDPKTTSKIHNY
                                                                                  300
                  *    *         *    *     *      *****  *   *****  **
SEQ ID NO:320     --VLGNKYQHKLLEIIDECELPEFLGGKCNC--IEGCQRSDKGPWKDPNIIKRVLNDEAN
SEQ ID NO:324     --VLGSNYQSRLLEVIDSSELPEFLGGSCTCSDKGGCLGSNKGPWNDPYILKLIHNLEAG
SEQ ID NO:334     --VLGSKYQNKLLEIIDENELPEFFGGKCKCKEAFGGCKKSDKGPWKDPNIIKRVLNGEAN
SEQ ID NO:340     --VLGNKYQSKLLEVIDASELPEFLGGTCTCEDQGGCLRSDKGPWKNPDIFKMVLTGGAW
SEQ ID NO:352     -VLGNNVLTDKILEIIDESELPEFLAGSCTCVDQGGCMRSDKGPWQDPNILKMVYVVKL
SEQ ID NO:375     SILLCFAYISDV-SFICFSELPEFLGGACTCADQGGCMLSDKGPWKNPEIVKMVLHGGAH
                                                                                  360
```

FIGURE 12C

```
SEQ ID NO:320   YG-RQIVTISSIDGKIIRYARPDHPTRKG---SDAS-AESGSEVEDVTSPTASRNLITHPI
SEQ ID NO:324   CMRETTKPVSEGGERSSSSFRLEQMKWQGMLSDTSNAESGSDVDDFGPSF-VHKVSGYGC
SEQ ID NO:334   YG-RQIVTISSTDGKIIRYAGPQYPTRKG---SDGS-AESGSEVEDGASPMASRNLITNPL
SEQ ID NO:340   RS-KQVVKVLNNERKVIVYAKPGYPMVKG---SDTSTAESGSEAEDIS-SPKAMKSYSHLT
SEQ ID NO:352   DVFSKIVTVSNDEGRVIECDKISYPMIRG---SDTSTGESGSEVEDIA-SPKACGNCISSM
SEQ ID NO:375   RA-KQVVKVLNSDGKVIAYAKPSYPWIKG---SDTSTAESGSEAEDIVVSPKAVKSYSHLR
                                                                             420

SEQ ID NO:320   LTPVHEESKLSPHGSTFVAH-ASIEENIPVVDKVVDDGWGTPRGSLQA--SSGSLPSRNT
SEQ ID NO:324   LTPVREEVK----GTDCATYLSCDD----------------------------------
SEQ ID NO:334   LTPVHEESKLAAHGFTSASP-SIIEESIPVVDKVVDDGWGSPRAS------SSPSRSL
SEQ ID NO:340   LTPVHEEAKIV-GKTSYASNLSGYDEYVPMVDIPVDAGWK-KQASLQRSYTSKGAPPPDT
SEQ ID NO:352   LTPVLEEARMV-GKTSHAGSLV---EYVPMVDKAINVGSKEKQATPRKLFCSTAG----
SEQ ID NO:375   LTPVREEAKVGSGETSFAGSFAGYDEYVPMVDKAVDATWKVKPTAINRAPSKGAHMPPNV
                                                                             480

SEQ ID NO:320   HGTFEGLRVQAVAWLTFLITALFATLCSVPSKMARRISSQSSKHDDYRGEYPQEEEEHKE
SEQ ID NO:324   ------------------------------------------------------------
SEQ ID NO:334   PITFDGLWTQVITWLTVLIVSLFAMVRSVPSRMAKRFSSQSTDHDHSYVEYPQEAE-YKE
SEQ ID NO:340   QKTPEGIQARMWVALSIFFLTVLTLLRQVAYPV-TKKFPALSSNDDKSTSKPPPDTTNME
SEQ ID NO:352   ------------FILALYTFARSITFRVTKGMRYSESNSARNILNMTVDSISKGE------
SEQ ID NO:375   PKDHESFSARVLVTFMAFVMAILTFFRTVSNRVVTKQLP----------PPPSQPQIE
                                                                             540
```

FIGURE 12D

```
                    *         ****         *  ****          *       *  *************  *******
SEQ ID NO:320  EFRPPSPAPSYTEKDVLSSMLRRLGELEGRVQVLETKPSEMPFEKEELLNAAVRRVDALE
SEQ ID NO:324  ----------------------------------------QSHPDMVP-----------
SEQ ID NO:334  EFRPPSPAPSYTEKDVLSSMVRRLGELEEKVQALETKPSEMPFEKEELLNAAVRRVDALE
SEQ ID NO:340  VLPPSSTPSC-TEENLLPSMLKRLGELEEKVDTLQSKPSEMPYEKEELLNAAVCRVDALE
SEQ ID NO:352  SRPPSYSPGGFTKANLPSSTLKRLGELEEKVDMLQSKPSVMPHEKEELLNAAVYRVDALE
SEQ ID NO:375  ----GSAAA-EEADLLNSVLKKLTELEEKIGALQSKPSEMPYEKEELLNAAVCRVDALE
                                                                         600
                                                                    541

****  ***    *    **    *****           *   *   **       *
SEQ ID NO:320  AELISTKKALYDALMRQDELLAYIDRQELIKFRKKK-----FCF
SEQ ID NO:324  ------EFYHGVQRTTE---------------------------
SEQ ID NO:334  AELISTKKALYEALMRQDELLAYIDKQDMIKFRKKK-----FCF
SEQ ID NO:340  AELIATKKALYDALMRQEELLAYIDRQEEAKLRKKK-----FCW
SEQ ID NO:352  AELIATKKALYEALIRQEELMAYIDSQERDKFKRKG-----CW
SEQ ID NO:375  AELIATKKALYEALMRQEELLAYIDRQEAAQHQKKNKRKQMFCF
                                                            644
                                                       601
```

POLYNUCLEOTIDES ENCODING PROTEINS INVOLVED IN PLANT METABOLISM

This application is a divisional of U.S. patent application Ser. No. 11/302,607, filed Dec. 13, 2005, now abandoned, which is a divisional of U.S. patent application Ser. No. 10/062,254, filed Feb. 1, 2002, now abandoned, which is a continuation of U.S. patent application Ser. No. 09/630,346, filed Jul. 28, 2000, now abandoned, and claims priority to U.S. Provisional Application Nos. 60/146,511, filed Jul. 30, 1999; 60/156,006, filed Sep. 23, 1999; 60/156,899, filed Sep. 30, 1999; 60/157,287, filed Oct. 1, 1999; 60/169,767, filed Dec. 9, 1999; 60/171,054, filed Dec. 16, 1999; 60/172,958, filed Dec. 21, 1999; 60/171,515, filed Dec. 22, 1999; and 60/173,535, filed Dec. 29, 1999, all of which are incorporated herein by reference.

TECHNICAL FIELD

The present invention relates generally to plant molecular biology. More specifically, it relates to nucleic acid sequences, the amino acids sequences encoded by such nucleic acids, and methods for modulating their expression in plants.

BACKGROUND OF THE INVENTION

Pyruvate Dehydrogenase Kinase (PDK)

Manipulating major cellular processes at individual key regulatory points may provide a relatively simple means to affect several phenotypes. Respiration and lipid biosynthesis for example may be simultaneously modified by altering levels of acetyl-CoA which both serve as entry point into the Krebs cycle as well as primary substrate for fatty acid biosynthesis. Increased respiration may be manifested in an increase in seed growth as in soybean (Sinclair et al. (1987) *Plant Physiol* 83:467-468) whereas decreased respiration may lead to decreased reproductive growth (Gale (1974) *J Exp Bot* 25:987-989).

The pyruvate dehydrogenase enzyme complex catalyzes the oxidative phosphorylation of pyruvate into acetyl-CoA. The multienzyme complex is composed of many different enzymes that catalyze different reactions in forming acetyl-CoA. Pyruvate dehydrogenase (E1) is a thiamine pyrophosphate (TPP)-requiring enzyme that decarboxylates pyruvate with the formation of hydroxyethyl-TPP. The hydroxyethyl group attacks the disulfide bond of the lipoamide moiety of the second enzyme, dihydrolipoyl transacetylase (E2) to form acetyl-dihydrolipoamide-E2 and regenerate E1. E2 then catalyzes the transfer of the acetyl group to CoA, forming acetyl-CoA and dihydrolipoamide-E2. Dihydrolipoyl dehydrogenase (E3) via its flavin adenine dinucleotide (FAD) group oxidizes the dihydrolipoamide moiety linked to E2, regenerating lipoamide-E2. Reduced E3 is then reoxidized by NAD+, forming NADH. In eukaryotes, the complex is composed of 30 E1 dimers and 6 E3 dimers around a core of 60 E2 monomers arranged in a dodecahedron.

One mechanism of regulating pyruvate dehydrogenase activity is its phosphorylation state. The enzyme pyruvate dehydrogenase kinase or PDK inactivates the E1 subunit by catalyzing the phosphorylation of a specific E1 Ser residue using ATP. Hydrolysis of this phospho-Ser residue by the pyruvate dehydrogenase phosphatase reactivates the complex. This form of regulation operates only in mitochondria and not in chloroplasts. Suppressing pyruvate dehydrogenase activity may therefore lead to increased mitochondrial pyruvate dehydrogenase activity leading to increased respiration and fatty acid and hence oil biosynthesis. Suppression of pyruvate dehydrogenase kinase activity may be accomplished by downregulating expression of genes encoding pyruvate dehydrogenase kinase by technology well known to those skilled in the art which include antisense inhibition and cosuppression. Indeed, WO 98/35044 describes transgenic *Arabidopsis thaliana* plants transformed with antisense constructs of the *Arabidopsis* pyruvate dehydrogenase kinase gene as having increased pyruvate dehydrogenase activity, increased activity of enzymes involved in the Krebs cycle, increased overall oil content, and shorter flowering time as brought about by increased respiration, without any apparent deleterious effects. Nucleic acid fragments encoding pyruvate dehydrogenase kinase have also been isolated from maize (Thelen et al. (1998) *J Biol Chem* 273:26618-26623) The domains responsible for catalysis and recognition and binding of substrates remain to be defined. Accordingly, the availability of nucleic acid sequences encoding all or a portion of pyruvate dehydrogenase kinase would facilitate studies that address these issues and could provide genetic tools to enhance or otherwise alter the accumulation of carbohydrates, lipids and proteins in plants and seeds.

Dihydrolipoamide Dehydrogenase

Carbon flux in living organisms is governed by intricate metabolic pathways linked together by regulatory mechanisms that take their cue from a variety of signals including but not limited to the environment, the developmental stage, genetics, and physiology. It is becoming common practice to alter accumulation of certain metabolites by manipulating expression of a key enzyme in the relevant pathway. For example, U.S. Pat. No. 5,773,691 describes a method of increasing the lysine content of seeds by overexpressing in a seed-specific manner a gene encoding the enzyme dihydrodipicolinic acid synthase, a major regulatory point in lysine biosynthesis.

An enzyme that is part of a number of several metabolic pathways is dihydrolipoamide dehydrogenase. Dihydrolipoamide dehydrogenase is a flavoprotein that catalyzes the oxidation of dihydrolipoyl moieties of noncovalently associated proteins in multienzyme complexes including the pyruvate dehydrogenase complex, α-ketoglutarate dehydrogenase complex, and branched-chain α-ketoacid dehydrogenase complex, where it is referred to as the E3 component, because it is the third enzyme in the reaction mechanism. Dihydrolipoamide dehydrogenase has also been shown to be a component of the glycine cleavage system, where it is referred to as the L protein. These E3-dependent enzyme complexes catalyze key regulatory reactions in intermediary metabolism, including plant leaf respiration. In plants, the plastid form of the pyruvate dehydrogenase complex provides acetyl-CoA and NADH for fatty acid biosynthesis. The importance of this enzyme is demonstrated by the fact that mice that have both copies of the gene encoding dihydrolipoamide dehydrogenase inactivated die prenatally (Johnson et al. (1997) *Proc Natl Acad Sci USA* 94:14512-14517).

Genes encoding dihydrolipoamide dehydrogenase have been isolated from prokaryotes (Stephens et al. (1983) *Eur J Biochem* 135:519-527), yeast (Ross et al. (1988) *J Gen Microbiol* 134:1131-1139) and animals (Johnson et al. (1997) *Genomics* 41:320-326). A gene encoding the mitochondrial enzyme in pea leaves has been isolated. It is believed that a single nuclear gene encodes the same mitochondrial dihydrolipoamide dehydrogenase in the pyruvate dehydrogenase and glycine decarboxylase complexes (Turner et al (1992) *J Biol Chem* 267:7745-7750; Bourguignon et al. (1996) *Biochem J* 313:229-234). The plastidic counterpart has been biochemically characterized, and appears to be distinct from the mitochondrial enzyme. They appear to share limited sequence similarity, and antibodies to the mitochondrial enzyme did not readily cross-react with its plastidic counterpart (Conner et al. (1996) *Planta* 200:195-202). The gene encoding the plastidic dihydrolipoamide dehydrogenase remains to be isolated. Accordingly, the availability of nucleic acid sequences encoding novel amino acid sequences of dihydrolipoamide dehydrogenase would facilitate studies to better understand carbon flux in plants and could provide genetic tools to enhance or otherwise alter the accumulation of particular metabolites like fatty acids during plant growth and development.

Steroid Dehydrogenase

Steroids constitute an integral component of plant membranes. They decrease fluidity and probably are involved in the adaptation of membranes to temperature. More recently, the importance of steroids as plant hormones has been the subject of intense study, stemming from the discovery that *Arabidopsis* de-etiolated (det2) and the constitutive photomorphogenesis and dwarfism (cpd) mutants are defective in the synthesis of brassinosteroids (Li et al. (1996) *Science* 272:398-401; Szekeres et al. (1996) *Cell* 85:171-182).

Structurally similar to animal steroids, brassinosteroids have been shown to elicit a broad spectrum of responses including stem elongation, inhibition of root growth, repression of stress-regulated genes, pollen-tube growth and xylem differentiation (Rouleau et al. (1999) *J Biol Chem* 274:20925-20930; Schumacher and Chory (2000) *Curr Opin Plant Biol* 3:79-84).

3-beta-hydroxy-delta(5)-steroid dehydrogenase (EC 1.1.1.145) is also called progesterone reductase. It is an oxidoreductase which acts on the CH—OH group of donors with NAD+ or NADP+ as acceptors in the C-21 steroid metabolism and the androgen and estrogen metabolisms. The enzyme converts 3 beta hydroxy-5-ene-steroids into 3-keto-4-ene derivatives and interconverts 3 beta-hydroxy and 3-keto-5 alpha-androstane steroids (Labrie et al. (1992) *J. Steroid Biochem. Mol. Biol.* 41:421-435). This enzyme is essential for the biosynthesis of all active steroid hormones (Payne et al. (1997) *Steroids* 62:169-175). Levels of steroid dehydrogenases may therefore be altered to control steroid hormone biosynthesis and responses in living matter, including enhanced biomass production as seen in transgenic plants overexpressing DET2.

Plant Homologs of Yeast RFT1

Cells divide by duplicating their chromosomes and segregating one copy of each duplicated chromosome, as well as providing essential organelles, to each of two daughter cells. Regulation of cell division is critical for the normal development of multicellular organisms. A cell that is destined to grow and divide must pass through specific phases of a cell cycle: $G_1$, S (period of DNA synthesis), $G_2$, and M (mitosis). Studies have shown that cell division is controlled via the regulation of two critical events during the cell cycle: initiation of DNA synthesis and the initiation of mitosis. Several kinase proteins control cell cycle progression through these events. These protein kinases are heterodimeric proteins, having a cyclin-dependent kinase (Cdk) subunit and a cyclin subunit that provides the regulatory specificity to the heterodimeric protein. These heterodimeric proteins regulate cell cycle by interacting with proteins involved in the initiation of DNA synthesis and mitosis and phosphorylating them at specific regulatory sites, activating some and inactivating others. The cyclin subunit concentration varies in phase with cell cycle while the concentration of the Cdks remain relatively constant throughout the cell cycle.

Cells with damaged DNA become arrested in G1 and G2 while the damage is repaired. The p53 protein is involved in this inhibition. The p53 protein is a trans-activator protein that acts to regulate cellular division by controlling a set of genes required for this process (Koerty et al. (1995) *J. Biol. Chem.* 270(38):22556-22564). Upon DNA damage p53 concentrations increase which stimulates the expression of a cyclin-dependent kinase inhibitor (Kasiae et al. (1991) *Cell* 71:587-597). This protein inhibits the activity of G1 Cdk-cyclin complexes which in turn inhibits cell cycle progression (Hollstein et al (1991) *Science* 253:49-53 and Koerty et al. (1995) *J. Biol. Chem.* 270(38):22556-22564).

The p53 gene is under intense investigation by many labs involved in mammalian cell biology, however p53 homologues have not been identified in plants. In yeast, mutations in the RFT1 gene result in defective cell cycle progression. Recent genetic and biochemical studies indicate that wild type human p53 can suppress RFT1 mutations and that the RFT1 gene product interacts physically with p53. The work suggests that the RFT1 protein may represent a novel p53 binding factor yet to be identified from mammalian cells (Koerty et al. (1995) *J. Biol. Chem.* 270(38):22556-22564).

There is a great deal of interest in identifying the genes that encode cell cycle regulatory proteins including p53-associated proteins in plants. These genes may be used to express cell cycle regulatory proteins in plant cells to control cell cycle, modulate cell division and possibly enhance cell tissue culture growth. Accordingly, the availability of nucleic acid sequences encoding all or a portion of a cell cycle regulatory protein would facilitate studies to better understand cell cycle regulation in plants, provide genetic tools to enhance cell growth in tissue culture. Cell cycle regulatory proteins may also provide targets to facilitate design and/or identification of inhibitors of cell cycle regulatory proteins that may be useful as herbicides.

Phosphoinositide Binding Proteins

Phosphatidylinositol transfer proteins (PITPs) belong to a broad class of lipid transfer proteins that are able to transfer lipids between membranes in vitro. Specifically, PITPs are able to transfer phosphatidylinositol and in some cases phosphatidylcholine (PC). They have been described in microorganisms, animals, and plants. Interestingly, PITPs diverge in amino acid sequence. The PITP encoded by SEC14 in *Saccharomyces cerevisiae* does not have sequence similarity with the mammalian PITPs, and show only limited homology with the soybean and *Arabidopsis* PITPs. PITPs from different organisms may substitute for one another in vitro assays or in complementation studies but appear to vary in biological function. For example, the SEC14 gene product in *Saccharomyces cerevisiae* is essential for survival, involved in protein exit from the yeast Golgi complex. It regulates the nucleotide pathway of PC biosynthesis by binding PC when PC level in the membrane is high resulting in the inhibition of CTP cytidylyltransferase, an enzyme in PC biosynthesis in yeast Golgi membranes. This maintains a critical diacylglycerol pool required for Golgi secretory function. Meanwhile, the SEC14 protein in the dimorphic yeast *Yarrowia lipolytica* is not essential for viability but required for differentiation to the mycelial form but does not appear to play a role in PC biosynthesis (Lopez et al. (1994) *J Cell Biol* 125:113-127). In mammalian systems, PITP has been shown to be required for epidermal growth factor signaling (Kauffmann-Zeh, et al. (1995) *Science* 268:1188-1190) and to participate in secretory vesicle formation (Ohashi et al. (1995) *Nature* 377:544-547).

Plant PITPs have been studied in less detail. More recently, two soybean proteins, Ssh1p and Ssh2p that have been identified by their ability to rescue PITP-deficient *Saccharomyces cerevisiae* strains were shown to exhibit biochemical properties different from those of known PITPs. Ssh1p has neither PI-transfer activity nor PC-transfer activity, whereas Ssh2p has PI-transfer activity but no accompanying PC-transfer activity. Both however have high affinity to phosphoinositides, unlike SEC14. Moreover, Ssh1p may function as a component of a stress response pathway that leads to protection from osmotic insult (Kearns et al. (1998) *EMBO J* 17:4004-4017). An *Arabidopsis* cDNA that complements the sec 4 mutation has been isolated and was found to encode a protein that has homology to the SEC14 protein. The encoded protein has been shown capable of transferring PI but not PC, like Ssh2p. Its biological role remains to be determined (Jouannic et al. (1998) *Eur J Biochem* 258:402-410).

Isolation of more plant phospholipid transfer proteins and phospholipid-binding proteins should allow further characterization of their structure and function, and the generation of transgenic plants that exploit their utility (e.g., engineering transgenic plants with increased tolerance to abiotic stress or with more efficient lipid and/or protein transport using these proteins).

Peroxisomal Lipid Transfer Proteins

Peroxisomes are spherical cell organelles delimited by a unit membrane where metabolic pathways that produce toxic metabolites are localized, thus preventing the spread of harmful substances in the cell. The β-oxidation pathway of lipid catabolism and photorespiration both occur in peroxisomes. During the conversion of fatty acids to succinate via β-oxidation, hydrogen peroxide and glyoxylate are generated. During photorespiration, phosphoglycolate that is produced from oxidation of ribulose1,5-bisphosphate is dephosphorylated, and then transported to peroxisomes where it is further oxidized to hydrogen peroxide and glyoxylate. In the peroxisome, hydrogen peroxide is neutralized by catalase, while glyoxylate is transamidated to produce glycine. The lethality of genetic disorders such as Zellweger syndrome in humans wherein peroxisomes fail to assemble underscores the importance of peroxisomes. Zellweger patients have impaired plasmalogen and bile acid synthesis, and catabolize phytanic acid and very long fatty acids.

Lipid transfer proteins in peroxisomes have not been examined in much detail. Peroxisomal nonspecific lipid transfer proteins are small basic polypeptides that are able to transfer phospholipids and sterols between membranes in vitro. Consequently, they are believed to facilitate movement of said molecules within cells. Genes encoding these proteins have been isolated from fungi and animals, but not yet from plants. In *Candida tropicalis*, a novel peroxisomal nonspecific lipid transfer protein is thought to have a role in regulating β-oxidation (Tan et al. (1990) *Eur J Biochem* 190:107-112). A cDNA encoding human nonspecific lipid transfer protein (or sterol carrier protein 2 [$SCP_2$]) with a peroxisome targeting sequence was shown to enhance progestin synthesis, lending support to the notion that $SCP_2$ is involved in regulating steroid hormone synthesis (Yamamoto et al. (1991) *Proc Natl Acad Sci USA* 88:463-467). Overexpressing $SCP_2$ in rat hepatoma cells resulted in increase in cholesterol content of the plasma membrane, a finding consistent with the proposed function of $SCP_2$ in the rapid movement of newly synthesized cholesterol to the plasma membrane (Baum et al. (1997) *J Biol Chem* 272:6490-6498). Less is known about similar proteins in plants. Accordingly, the availability of nucleic acid sequences encoding all or a portion of peroxisome lipid transfer proteins would facilitate studies to better understand the mechanism of peroxisome function as well as lipid transport and the various pathways involving lipids (e.g., β-oxidation pathway) in plant peroxisomes and could provide genetic tools to enhance or otherwise alter the accumulation of macromolecules particularly lipids during plant growth and development.

RNA Polymerase II Subunit RPB9

Improvement of crop plants for a variety of traits, including disease and pest resistance, and grain quality improvements such as oil, starch or protein composition, can be achieved by introducing new or modified genes (transgenes) into the plant genome. Transcriptional activation of genes, including transgenes, is in general controlled by the promoter through a complex set of protein/DNA and protein/protein interactions. Promoters can impart patterns of expression that are either constitutive or limited to specific tissues or times during development.

In eukaryotic cells, genes encoding messenger RNA are transcribed by RNA polymerase II. Efficient transcription in eukaryotes is dependent upon the interaction of several polypeptides that comprise the basal transcriptional apparatus. Accurate initiation of transcription of class II genes depends upon assembly these peptides into the basal transcriptional complex containing RNA polymerase II and the general transcription factors (GTFs): TFIIA, TFIIB, TFIID, TFIIE, TFIIF, and TFIIH. Additionally, activator, coactivator and repressor proteins interact with the basal apparatus to regulate gene expression.

RNA polymerase II has long been known to be a large multimeric protein complex. Twelve of the polypeptides in the basal apparatus tightly assemble to form RNA polymerase II. The twelve polypeptides of RNA polymerase are: RPB1-9, RPB10α, RPB10β and RPB11. The role of several of these peptides has been elucidated in a number of systems, including humans, *Drosophila melanogaster* and *Saccharomyces cerevisiae*. The role of RPB9 in plants is not known.

RPB9 is a member of the RNA polymerase II complex. In *Saccharomyces*, it is one of only two subunits of RNA polymerase II not essential for cell viability. Deletion of RPB9 does not prevent formation of RNA polymerase II by the other 11 subunits, however, accurate transcriptional start site selection by RPB9-deficient RNA polymerase II is abrogated, causing transcription to initiate upstream from the correct start site. RPB9 appears to recognize DNA arrest sites and may transmit signals to the elongation ternary complex affecting the efficiency of RNA polymerase II elongation. Genetic analysis in yeast has identified the general transcription factor TFIIB as well as RPB9 as important in accurate transcriptional start site selection. Mutations in RPB9 suppress the downstream shift in start site selection caused by mutations in TFIIB. Thus TFIIB and RPB9 may functionally interact and this interaction may play an important role for efficient and accurate start site selection.

The instant invention concerns the identification and isolation of RPB9 in plants. The RPB9 subunit of RNA polymerase has been cloned from rice and several RPB9 subunit genes from other plants have been identified and isolated. Because most of the regulation of gene expression in eukaryotes occurs at the level of transcription, isolation of complete RNA polymerase II complexes would facilitate studies to better understand the interplay of the various polypeptides in the basal complex and the mechanisms that control transcription in plants. Thus, RPB9 can be used as a valuable tool to isolate complete RNA polymerase II from plant extracts. It may be possible to use RBP9 to gain an understanding of transcription in plants which will permit us to exploit this process and enhance our ability to manipulate target transgenes of interest in plants.

Transcription Factor IIA (TFIIA)

TFIIA is an important component of the basal transcription machinery of RNA polymerase II which is involved in mRNA synthesis. It functions at core promoters by serving to stabilize the interaction between the TATA promoter element with the TATA-binding protein (TBP) component of TFIID, another key component of the basal transcription machinery (Buratowski et al. (1989) *Cell* 56:549-561; Geiger et al. (1996) *Science* 272:830-836). TFIIA also appears to have activator-dependent functions, since TFIIA has been shown to interact directly with activators, and that these interactions correlate with the ability to enhance TFIID-TFIIA-promoter ternary complex assembly required for transcription initiation by RNA polymerase II (Kobayashi et al. (1995) *Mol Cell Biol* 15:6465-6473). Using a yeast strain that contains a TBP defective for interaction with TFIIA, TFIIA activator-dependent and core promoter functions were demonstrated in vivo (Stargell et al. (2000) *J Biol Chem* 275:12374-12380).

In yeast, TFIIA is composed of a large subunit of 32 kilodaltons encoded by the TOA1 gene, and a small subunit of 13.5 kilodaltons encoded by the TOA2 gene. Both genes have been cloned and neither shows obvious sequence similarity with each other (Ranish et al. (1992) *Science* 255:1127-1129). Both TOA1 and TOA2 genes are essential for growth of yeast, indicating the importance of TFIIA.

Ethylene Responsive Element Binding Protein (EREBP)

Ethylene induction of transcription of certain ethylene-inducible pathogenesis-related protein genes has been shown to be based on the presence of the GCC box in the promoter, also known as the ethylene-responsive element (ERE), an 11-bp sequence that is able to enhance ethylene-dependent transcription from a truncated 35S promoter of cauliflower mosaic virus (CaMV) (Ohme-Takagi and Shinshi (1995) *Plant Cell* 7:173-182). cDNAs encoding DNA-binding proteins that specifically bind the GCC box have been isolated, and their protein products designated ERE binding proteins, or EREBPs, are characterized by a DNA-binding domain called the AP2 domain (Okamuro et al. (1997) *Proc Natl Acad Sci* 94:7076-7081). Although the isolated EREBP genes exhibited different patterns of expression, all were shown to be inducible by ethylene in leaves, suggesting that altering EREBP expression may be a viable strategy to engineer plant response to ethylene, pathogen, and stress.

AC-rich Binding Factor (ACBF)

A study of the bean phenylalanine ammonia-lyase (PAL) gene promoter revealed the presence of positive and negative regulatory cis elements, including an AC-rich motif implicated in xylem expression (Seguin et al. (1997) *Plant Mol Biol* 35:281-291). A factor, named AC-rich binding factor (ACBF) was shown to specifically bind the AC-rich motif. The deduced amino acid sequence of ACBF contained a long repeat of glutamine residues characteristic of previously analyzed transcription factors. A heptamer of the AC-rich sequence was shown to drive xylem-specific expression of a minimal CaMV 35S promoter (Seguin et al. (1997) *Plant Mol Biol* 35:281-291), suggesting that by modulating ACBF expression, chimeric genes driven by promoter sequences with AC-rich sequence (ACBF binding site) may be expressed at optimal levels in a xylem-specific pattern. Also, ACBF expression levels may be engineered to regulate PAL levels, in the process regulating disease resistance response (since PAL is a key enzyme in the phenylpropanoid pathway which produces several defense-related metabolites) and isoflavone synthesis.

YABBY Transcription Factors

Flower development is a complex process fine-tuned to environmental cues that involves transition from vegetative state to reproductive development and the actual differentiation of the floral meristem into the different floral organs at predetermined positions. During the past several years, major advances have been made towards defining the process at the molecular level. Several mutants in *Arabidopsis*, snapdragon, and other plant species with impaired floral development have been characterized, and the corresponding genes cloned, including PLENA (PLE)/AGAMOUS (AG) (Yanofsky et al. (1990) *Nature* 346:35-39; Bradley et al. (1993) *Cell* 72:85-95), DEFICIENS (DEF)/APETALA3 (AP3) (Sommer et al. (1990) *EMBO J* 9:605-613; Jack et al. (1992) *Cell* 68:683-697), and GLOBOSA (GLO)/PISTILLATA (PI) (Tröbner et al. (1992) *EMBO J* 11:4693-4704; Goto and Meyerowitz (1994) *Genes Dev* 8:1548-1560). Most of these floral organ identity genes, whose presence or absence of expression determines what a particular whorl of floral organs would develop into, encode transcription factors, indicating a major role of transcriptional regulation in flower development. The above-mentioned genes for example belong to a family that encodes proteins with an amino-terminal DNA-binding and dimerization domain called the MADS domain, after the initials of the first four members of this gene family, MCM1, AG, DEF, and SRF (Schwarz-Sommer et al. (1990) *Science* 250:931-936).

Another family of transcription factors involved in floral development and meristem formation is the YABBY gene family, to which the genes FILAMENTOUS FLOWER (FIL) and CRABS CLAW (CRC) belong. These genes specify abaxial cell fate which is incompatible with a meristematic state (Siegfried et al. (1999) *Development* 126:4117-4128) in above ground lateral organs including leaves and flowers. Fil mutants generate underdeveloped flowers that fail to form receptacles and floral organs, and flowers with altered number and shape of floral organs (Sawa et al. (1999) *Genes Dev* 13:1079-1088), whereas crc mutants have nectaries that fail to develop and abnormal carpels (Alvarez and Smyth (1999) *Development* 126:2377-2386). FIL and CRC encode transcription factors containing a zinc finger and a helix-loop-helix similar to the first two helices of the HMG box known to bind DNA (Sawa et al. (1999) *Genes Dev* 13:1079-1088; Bowman and Smyth (1999) *Development* 126:2387-2396). FIL expression is restricted to abaxial tissues while CRC expression extends slightly beyond abaxial tissues, being found also in cells adjacent to the presumptive placental positions in developing carpels (Eshed et al. (1999) *Cell* 99:199-209).

There is a great deal of interest in identifying the genes that encode transcription factors involved in flower development and meristem formation and activity. These genes may be used to engineer plant development and consequently improve yield. Accordingly, the availability of nucleic acid sequences encoding all or a portion of YABBY transcription factors would facilitate studies to better understand the role of said transcription factors in flower and meristem development, to define their gene targets in the whole process, to reconstruct their evolution and analyze phylogenetic relationships, and could provide genetic tools to enhance plant productivity.

Plant Multiprotein Bridging Factors

In eukaryotes transcription initiation requires the action of several proteins acting in concert to initiate mRNA production. Two cis-acting regions of DNA have been identified that bind transcription initiation proteins. The first binding site located approximately 25-30 bp upstream of the transcription initiation site is termed the TATA box. The second region of DNA required for transcription initiation is the upstream activation site (UAS) or enhancer region. This region of DNA is somewhat distal from the TATA box. During transcription initiation RNA polymerase II is directed to the TATA box by general transcription factors. Transcription activators which have both a DNA binding domain and an activation domain bind to the UAS region and stimulate transcription initiation by physically interacting with the general transcription factors and RNA polymerase. Direct physical interactions have been demonstrated between activators and general transcription factors in vitro, such as between the acidic activation domain of herpes simplex virus VP16 and TATA-binding protein (TBP), TFIIB, or TFIIH (Triezenberg et al. (1988) *Gene Dev.* 2:718-729; Stringer et al. (1990) *Nature* 345:783-786; Lin et al. (1991) *Nature* 353:569-571; Xiao et al. (1994) *Mol. Cell. Biol.* 14:7013-7024).

A third factor that is involved in transcription initiation is the coactivator protein. It is thought that coactivator proteins serve to mediate the interaction between transcriptional activators and general transcription factors. Functional and physical interactions have also been demonstrated between the activators and various transcription coactivators. These transcription coactivators normally can not bind to DNA directly, however they can "bridge" the interaction between transcription activators and general transcription factors (Pugh and Tjian (1990) *Cell* 61:1187-1197; Kelleher et al. (1990) *Cell* 61:1209-1215; Berger et al. (1990) *Cell* 61:1199-1208). One such "bridging" protein identified in *Drosophila* is the multiprotein bridging factor 1 (MBF1) transcriptional cofactor (Takemaru et al., (1997) *PNAS* 94(14):7251-7256). This protein has been shown to act as a transcriptional cofactor that interacts with the TATA-binding protein and nuclear hormone receptor FTZ-F1 in *Drosophila*.

Accordingly, the availability of nucleic acid sequences encoding all or a portion of plant MBF1 transcription coactivator proteins would facilitate studies to better understand transcription initiation in plants and ultimately provide methods to engineer mechanisms to control transcription.

SUMMARY OF THE INVENTION

Generally, it is the object of the present invention to provide nucleic acids and proteins relating to plant metabolism, including pyruvate dehydrogenase kinase. It is an object of the present invention to provide transgenic plants comprising the nucleic acids of the present invention, and methods for modulating, in a transgenic plant, expression of the nucleic acids of the present invention.

Therefore, in one aspect the present invention relates to an isolated nucleic acid comprising a member selected from the group consisting of (a) a polynucleotide having a specified sequence identity to a polynucleotide encoding a polypeptide of the present invention; (b) a polynucleotide which is complementary to the polynucleotide of (a); and, (c) a polynucleotide comprising a specified number of contiguous nucleotides from a polynucleotide of (a) or (b). The isolated nucleic acid can be DNA.

In other aspects the present invention relates to: 1) recombinant expression cassettes, comprising a nucleic acid of the present invention operably linked to a promoter, 2) a host cell into which has been introduced the recombinant expression cassette, and 3) a transgenic plant comprising the recombinant expression cassette. The host cell and plant are optionally from maize, wheat, rice, or soybean.

DETAILED DESCRIPTION OF THE INVENTION

Overview

A. Nucleic Acids and Protein of the Present Invention

Unless otherwise stated, the polynucleotide and polypeptide sequences identified in Table 1 represent polynucleotides and polypeptides of the present invention. Table 1 lists the polypeptides that are described herein, the designation of the cDNA clones that comprise the nucleic acid fragments encoding polypeptides representing all or a substantial portion of these polypeptides, and the corresponding identifier (SEQ ID NO:) as used in the attached Sequence Listing. Table 1 also identifies the cDNA clones as individual ESTs ("EST"), the sequences of the entire cDNA inserts comprising the indicated cDNA clones ("FIS"), contigs assembled from two or more ESTs ("Contig"), contigs assembled from an FIS and one or more ESTs ("Contig*"), or sequences encoding the mature protein derived from an EST, FIS, a contig, or an FIS and PCR ("CGS"). The sequence descriptions and Sequence Listing attached hereto comply with the rules governing nucleotide and/or amino acid sequence disclosures in patent applications as set forth in 37 C.F.R. §1.821-1.825.

TABLE 1

Proteins Relating to Plant Gene Transcription, Metabolism, and Physiology

| | | | SEQ ID NO | |
|---|---|---|---|---|
| Protein (Plant Source) | Clone Designation | Status | (Polynucleotide) | (Polypeptide) |
| PDK (Rice) | Contig of rlr24.pk0080.b1 rls6.pk0077.c1 | Contig | 1 | 2 |
| PDK (Rice) | rls6.pk0077.c1 (FIS) | CGS | 3 | 4 |
| PDK (Rice) | rr1.pk078.c2 | EST | 5 | 6 |
| PDK (Rice) | Contig of | Contig | 7 | 8 |

TABLE 1-continued

Proteins Relating to Plant Gene Transcription, Metabolism, and Physiology

| Protein (Plant Source) | Clone Designation | Status | SEQ ID NO (Polynucleotide) | (Polypeptide) |
|---|---|---|---|---|
| | rds2c.pk006.b20 | | | |
| | rsr9n.pk002.i20 | | | |
| PDK (Rice) | rsr9n.pk002.i20 (FIS) | CGS | 9 | 10 |
| PDK (Soybean) | sgc2c.pk001.o9 | EST | 11 | 12 |
| PDK (Soybean) | sgc2c.pk001.o9 (FIS) | CGS | 13 | 14 |
| PDK (Soybean) | sgs2c.pk004.k10 | EST | 15 | 16 |
| PDK (Soybean) | sl2.pk131.h2 | EST | 17 | 18 |
| PDK (Soybean) | sml1c.pk001.m24 | EST | 19 | 20 |
| PDK (Wheat) | Contig of wl1n.pk0102.e9 wlm0.pk0018.f3 wlm96.pk0020.d2 wlm96.pk061.l12 wr1.pk164.e12 wr1.pk167.c6 wre1n.pk183.h2 | Contig | 21 | 22 |
| PDK (Wheat) | wlm96.pk0020.d2 (FIS) | CGS | 23 | 24 |
| RFT1 Homolog (Corn) | Contig of cco1n.pk087.j16 p0041.crtap01r | Contig | 25 | 26 |
| RFT1 Homolog (Corn) | Contig of cco1n.pk087.j16 (FIS) p0041.crtap01r | Contig* | 27 | 28 |
| RFT1 Homolog (Rice) | rl0n.pk096.k13 | EST | 29 | 30 |
| RFT1 Homolog (Rice) | rl0n.pk096.k13 | FIS | 31 | 32 |
| Phosphoinositide Binding Protein (Jerusalem Artichoke) | he1.pk0013.c8 | EST | 33 | 34 |
| Phosphoinositide Binding Protein (Jerusalem Artichoke) | he1.pk0013.c8 (FIS) | CGS | 35 | 36 |
| Phosphoinositide Binding Protein (Barley) | bsh1.pk0013.c3 | EST | 37 | 38 |
| Phosphoinositide Binding Protein (Grape) | Contig of vdb1c.pk009.b9 vdb1c.pk010.j20 | Contig | 39 | 40 |
| Phosphoinositide Binding Protein (Grape) | vdb1c.pk010.j20 (FIS) | CGS | 41 | 42 |
| Phosphoinositide Binding Protein (Corn) | p0127.cntbd60r | EST | 43 | 44 |
| Phosphoinositide Binding Protein (Corn) | p0127.cntbd60r (FIS) | CGS | 45 | 46 |
| Phosphoinositide Binding Protein (Corn) | Contig of p0018.chstf54r p0109.cdadd47r | Contig | 47 | 48 |
| Phosphoinositide Binding Protein (Corn) | p0109.cdadd47r (FIS) | CGS | 49 | 50 |
| Phosphoinositide Binding Protein (Corn) | Contig of cr1n.pk0030.g6 cr1n.pk0097.e12 p0094.csstb82r | Contig | 51 | 52 |
| Phosphoinositide Binding Protein (Corn) | Contig of cr1.pk0011.c1 cr1n.pk0113.c3 p0083.cldaz94r p0094.csstb82r (FIS) | CGS | 53 | 54 |
| Phosphoinositide Binding Protein (Rice) | Contig of rds2c.pk005.e5 rl0n.pk0031.e10 | Contig | 55 | 56 |
| Phosphoinositide Binding Protein (Rice) | rl0n.pk0031.e10 (FIS) | CGS | 57 | 58 |
| Phosphoinositide Binding Protein (Rice) | Contig of rds1c.pk007.h14 rds3c.pk001.b10 rsl1n.pk010.j9 rsl1n.pk010.l3 | Contig | 59 | 60 |
| Phosphoinositide Binding Protein (Soybean) | sdp4c.pk006.h12 | EST | 61 | 62 |
| Phosphoinositide Binding Protein (Soybean) | sdp4c.pk006.h12 (FIS) | CGS | 63 | 64 |
| Phosphoinositide Binding Protein (Wheat) | wlm4.pk0003.g1 | EST | 65 | 66 |

TABLE 1-continued

Proteins Relating to Plant Gene Transcription, Metabolism, and Physiology

| Protein (Plant Source) | Clone Designation | Status | SEQ ID NO (Polynucleotide) | SEQ ID NO (Polypeptide) |
|---|---|---|---|---|
| Phosphoinositide Binding Protein (Wheat) | wlm4.pk0003.g1 (FIS) | CGS | 67 | 68 |
| Phosphoinositide Binding Protein (Wheat) | wlm4.pk0009.a8 | EST | 69 | 70 |
| Phosphoinositide Binding Protein (Wheat) | wlm4.pk0009.a8 (FIS) | CGS | 71 | 72 |
| Phosphoinositide Binding Protein (Wheat) | wdk2c.pk017.c19 | EST | 73 | 74 |
| Phosphoinositide Binding Protein (Wheat) | wle1n.pk0043.a10 | EST | 75 | 76 |
| Phosphoinositide Binding Protein (Wheat) | wyr1c.pk003.b6 | EST | 77 | 78 |
| Multiprotein Bridging Factor (Corn) | Contig of p0116.cesaj63r p0128.cpibn44r | CGS | 79 | 80 |
| Multiprotein Bridging Factor (Rice) | Contig of rlr12.pk0013.h12 rls6.pk0062.d5 | CGS | 81 | 82 |
| Multiprotein Bridging Factor (Soybean) | Contig of sls1c.pk008.p15 sr1.pk0016.d3 src3c.pk011.h11 | CGS | 83 | 84 |
| Multiprotein Bridging Factor (Wheat) | Contig of wr1.pk178.b2 wre1n.pk0104.f4 | CGS | 85 | 86 |
| Dihydrolipoamide Dehydrogenase (Corn) | Contig of cen1.pk0045.a8 p0016.ctsad33r | Contig | 87 | 88 |
| Dihydrolipoamide Dehydrogenase (Corn) | Contig of cpd1c.pk012.a12 cpe1c.pk011.d2 p0005.cbmei53r p0083.clddl26r p0095.cwsas06r | Contig | 89 | 90 |
| Dihydrolipoamide Dehydrogenase (Corn) | cpd1c.pk012.a12 (FIS) | CGS | 91 | 92 |
| Dihydrolipoamide Dehydrogenase (Corn) | Contig of cen3n.pk0095.g7 cen3n.pk0144.e11 | Contig | 93 | 94 |
| Dihydrolipoamide Dehydrogenase (Rice) | rsr9n.pk001.c9 | EST | 95 | 96 |
| Dihydrolipoamide Dehydrogenase (Rice) | rsr9n.pk001.c9 | FIS | 97 | 98 |
| Dihydrolipoamide Dehydrogenase (Soybean) | sfl1.pk131.f9 | EST | 99 | 100 |
| Dihydrolipoamide Dehydrogenase (Soybean) | sfl1.pk131.f9 (FIS) | CGS | 101 | 102 |
| Dihydrolipoamide Dehydrogenase (Wheat) | Contig of wlm1.pk0015.c4 wlmk1.pk0010.e2 wr1.pk0055.a12 wr1.pk0096.h7 | Contig | 103 | 104 |
| Peroxisomal Lipid Transfer Protein (Cattail) | etr1c.pk011.p10 (EST) | CGS | 105 | 106 |
| Peroxisomal Lipid Transfer Protein (*Eucalyptus*) | Contig of eef1c.pk005.c14 eef1c.pk007.h7 | CGS | 107 | 108 |
| Peroxisomal Lipid Transfer Protein (Corn) | Contig of cco1n.pk0006.d9 cdo1c.pk002.a17 p0107.cbcaq06r p0118.chsbm24r | CGS | 109 | 110 |
| Peroxisomal Lipid Transfer Protein (Corn) | cr1bio.pk0006.d6 (FIS) | CGS | 111 | 112 |
| Peroxisomal Lipid Transfer Protein (Para Rubber) | ehb2c.pk006.f22 (EST) | CGS | 113 | 114 |
| Peroxisomal Lipid Transfer Protein (Rice) | Contig of rds1c.pk006.a3 rr1.pk098.p24 rsl1n.pk002.f6 | CGS | 115 | 116 |
| Peroxisomal Lipid Transfer Protein | sgs2c.pk004.h19 (EST) | CGS | 117 | 118 |

TABLE 1-continued

Proteins Relating to Plant Gene Transcription, Metabolism, and Physiology

| Protein (Plant Source) | Clone Designation | Status | SEQ ID NO (Polynucleotide) | SEQ ID NO (Polypeptide) |
|---|---|---|---|---|
| (Soybean) | | | | |
| Peroxisomal Lipid Transfer Protein (*Vernonia*) | vs1n.pk013.j18 (EST) | CGS | 119 | 120 |
| Peroxisomal Lipid Transfer Protein (Wheat) | wlm96.pk031.g10 | EST | 121 | 122 |
| Peroxisomal Lipid Transfer Protein (Wheat) | Contig of wdk3c.pk006.d12 wlm96.pk054.b17 | CGS | 123 | 124 |
| Peroxisomal Lipid Transfer Protein (Florida Bitterbush) | pps.pk0007.h8 (FIS) | CGS | 125 | 126 |
| YABBY Transcription Factor (Corn) | cco1n.pk054.k9 (FIS) | CGS | 127 | 128 |
| YABBY Transcription Factor (Corn) | csi1.pk0013.g3 (FIS) | CGS | 129 | 130 |
| YABBY Transcription Factor (Corn) | cbn10.pk0049.f10 | EST | 131 | 132 |
| YABBY Transcription Factor (Corn) | Contig of cbn10.pk0049.f10(FIS) cco1n.pk054.n4 | CGS | 133 | 134 |
| YABBY Transcription Factor (Corn) | cbn2n.pk0002.h2 | EST | 135 | 136 |
| YABBY Transcription Factor (Corn) | cbn2n.pk0002.h2 (FIS) | CGS | 137 | 138 |
| YABBY Transcription Factor (Corn) | Contig of cco1.pk0040.f2 cco1n.pk0037.c3 p0016.ctsbz78r p0052.ckhah16r p0052.ckhak16r | CGS | 139 | 140 |
| YABBY Transcription Factor (Corn) | cco1.pk0040.f2 (FIS) | CGS | 141 | 142 |
| YABBY Transcription Factor (Corn) | p0083.cldau06r (EST) | CGS | 143 | 144 |
| YABBY Transcription Factor (Corn) | p0083.cldau06r (FIS) | CGS | 145 | 146 |
| YABBY Transcription Factor (Corn) | Contig of cbn10.pk0061.d5 p0081.chcaa15r p0083.clder38rb p0128.cpicc94r | CGS | 147 | 148 |
| YABBY Transcription Factor (Rice) | Contig of rca1n.pk027.i5 rds2c.pk008.o15 | Contig | 149 | 150 |
| YABBY Transcription Factor (Rice) | rds2c.pk004.h9 (FIS) | CGS | 151 | 152 |
| YABBY Transcription Factor (Soybean) | sfl1.pk0074.g3 (FIS) | CGS | 153 | 154 |
| YABBY Transcription Factor (Soybean) | Contig of sah1c.pk004.c9 sdp3c.pk006.m7 ssm.pk0020.f6 | CGS | 155 | 156 |
| YABBY Transcription Factor (Soybean) | sdp3c.pk006.m7 (FIS) | CGS | 157 | 158 |
| YABBY Transcription Factor (Soybean) | Contig of se1.pk0029.g11 sls1c.pk023.d12 | Contig | 159 | 160 |
| YABBY Transcription Factor (Soybean) | sfl1n.pk001.d4 (FIS) | CGS | 161 | 162 |
| YABBY Transcription Factor (Soybean) | Contig of sfl1.pk0060.f3 ssl1c.pk002.k23 | CGS | 163 | 164 |
| YABBY Transcription Factor (Soybean) | ssl1c.pk002.k23 (FIS) | CGS | 165 | 166 |
| YABBY Transcription Factor (Wheat) | Contig of wdk2c.pk0004.c5 wdk2c.pk007.c14 wdk9n1.pk001.n20 | Contig | 167 | 168 |
| YABBY Transcription Factor (Wheat) | wdk2c.pk007.c14(FIS) | CGS | 169 | 170 |
| YABBY Transcription Factor (Wheat) | Contig of wdk2c.pk017.c3 | Contig | 171 | 172 |

TABLE 1-continued

Proteins Relating to Plant Gene Transcription, Metabolism, and Physiology

| Protein (Plant Source) | Clone Designation | Status | SEQ ID NO (Polynucleotide) | SEQ ID NO (Polypeptide) |
|---|---|---|---|---|
| YABBY Transcription Factor (Wheat) | wkm2n.pk008.p10 wkm2n.pk008.p10 (FIS) | CGS | 173 | 174 |
| YABBY Transcription Factor (Wheat) | Contig of wle1.pk0003.a8 wle1n.pk0004.d6 | CGS | 175 | 176 |
| RPB9 (Corn) | cbn10.pk0004.g11 (FIS) | CGS | 177 | 178 |
| RPB9 (Corn) | p0018.chssr46rb (EST) | CGS | 179 | 180 |
| RPB9 (Rice) | rca1c.pk0004.d10(FIS) | CGS | 181 | 182 |
| RPB9 (Rice) | Contig of rdr1f.pk001.f2 rlm1n.pk001.e13 | Contig | 183 | 184 |
| RPB9 (Rice) | rlm1n.pk001.e13 (FIS) | CGS | 185 | 186 |
| RPB9 (Soybean) | Contig of se1.pk0003.d4 sfl1n1.pk001.o20 | CGS | 187 | 188 |
| RPB9 (Soybean) | sfl1n1.pk001.o20 (FIS) | CGS | 189 | 190 |
| RPB9 (Wheat) | wlm96.pk0007.a5 (EST) | CGS | 191 | 192 |
| RPB9 (Wheat) | Contig of wlm0.pk0009.g9 wre1n.pk0059.b9 | CGS | 193 | 194 |
| RPB9 (Wheat) | wre1n.pk0059.b9 (FIS) | CGS | 195 | 196 |
| EREBP Homolog (Corn) | Contig of ccase-b.pk0002.d5 csh3c.pk001.n24 | Contig | 197 | 198 |
| EREBP Homolog (Corn) | chpc8.pk0003.c2 (FIS) | CGS | 199 | 200 |
| EREBP Homolog (Corn) | cpf1c.pk001.a4 (FIS) | CGS | 201 | 202 |
| EREBP Homolog (Rice) | rl0n.pk096.h12 (FIS) | CGS | 203 | 204 |
| EREBP Homolog (Rice) | rls12.pk0001.d2 (FIS) | CGS | 205 | 206 |
| EREBP Homolog (Rice) | rls6.pk0076.e6 (FIS) | CGS | 207 | 208 |
| EREBP Homolog (Soybean) | Contig of ses2w.pk0013.d6 sne1x.pk004.j22 | Contig | 209 | 210 |
| EREBP Homolog (Soybean) | sfl1.pk0034.f3 (FIS) | CGS | 211 | 212 |
| EREBP Homolog (Soybean) | src2c.pk002.o23 (FIS) | CGS | 213 | 214 |
| EREBP Homolog (*Vernonia*) | vs1n.pk014.n9 (FIS) | CGS | 215 | 216 |
| EREBP Homolog(Wheat) | wdk3c.pk012.h14(FIS) | CGS | 217 | 218 |
| EREBP Homolog(Wheat) | wdr1f.pk003.15 (FIS) | CGS | 219 | 220 |
| 3-Beta-Hydroxy-Delta(5)-Steroid Dehydrogenase (African Daisy) | dms1c.pk001.p5 | EST | 221 | 222 |
| 3-Beta-Hydroxy-Delta(5)-Steroid Dehydrogenase (Corn) | Contig of cc1.pk0026.b9 ccase-b.pk0001.b2 | Contig | 223 | 224 |
| 3-Beta-Hydroxy-Delta(5)-Steroid Dehydrogenase (Corn) | Contig of ceb1.pk0094.e9 cen3n.pk0178.e9 | Contig | 225 | 226 |
| 3-Beta-Hydroxy-Delta(5)-Steroid Dehydrogenase (Para Rubber) | ehb2c.pk013.n19 | EST | 227 | 228 |
| Steroid Dehydrogenase (Corn) | Contig of ceb1.pk0039.e7 ces1f.pk004.i17 p0134.carab02r | Contig | 229 | 230 |
| Steroid Dehydrogenase (Soybean) | sgs2c.pk003.n17 | EST | 231 | 232 |
| Steroid Dehydrogenase (Wheat) | Contig of wdk9n.pk001.p2 wle1n.pk0058.f3 | Contig | 233 | 234 |
| ACBF Homolog (Corn) | cbn10.pk0004.d5 (FIS) | CGS | 235 | 236 |
| ACBF Homolog (Corn) | Contig of cco1n.pk071.f24 cco1n.pk080.g6 cpe1c.pk001.m16 p0005.cbmfb43r p0039.cvmag51r | CGS | 237 | 238 |
| ACBF Homolog (Corn) | ceb7f.pk003.n22 (FIS) | CGS | 239 | 240 |
| ACBF Homolog (Corn) | Contig of | CGS | 241 | 242 |

TABLE 1-continued

Proteins Relating to Plant Gene Transcription, Metabolism, and Physiology

| Protein (Plant Source) | Clone Designation | Status | SEQ ID NO (Polynucleotide) | SEQ ID NO (Polypeptide) |
|---|---|---|---|---|
|  | cbn10.pk0007.c6 |  |  |  |
|  | cca.pk0025.f4 |  |  |  |
|  | cen3n.pk0151.g4 |  |  |  |
|  | chpc8.pk0001.a11 |  |  |  |
|  | cph1c.pk001.o15 |  |  |  |
|  | cr1n.pk0029.g1 |  |  |  |
|  | p0083.clddg64r |  |  |  |
|  | p0104.cabak40r |  |  |  |
|  | p0126.cnldd44r |  |  |  |
| ACBF Homolog (Corn) | cpi1c.pk015.g7 | FIS | 243 | 244 |
| ACBF Homolog (Corn) | cpj1c.pk001.m24 | FIS | 245 | 246 |
| ACBF Homolog (Corn) | cpj1c.pk004.g16 (FIS) | CGS | 247 | 248 |
| ACBF Homolog (Corn) | csi1n.pk0031.b7 (FIS) | CGS | 249 | 250 |
| ACBF Homolog (Corn) | csi1n.pk0049.h2 (FIS) | CGS | 251 | 252 |
| ACBF Homolog (Corn) | p0127.cntak21r (FIS) | CGS | 253 | 254 |
| ACBF Homolog (Rice) | rca1n.pk012.b24 | FIS | 255 | 256 |
| ACBF Homolog (Rice) | rlr48.pk0014.a12 (FIS) | CGS | 257 | 258 |
| ACBF Homolog (Rice) | rls48.pk0018.d5 | FIS | 259 | 260 |
| ACBF Homolog (Rice) | rr1.pk0027.f11 | FIS | 261 | 262 |
| ACBF Homolog (Rice) | rr1.pk0068.d6 | FIS | 263 | 264 |
| ACBF Homolog (Rice) | rr1.pk079.o4 | FIS | 265 | 266 |
| ACBF Homolog (Soybean) | scn1c.pk001.i15 (FIS) | CGS | 267 | 268 |
| ACBF Homolog (Soybean) | scr1c.pk002.k6 (FIS) | CGS | 269 | 270 |
| ACBF Homolog (Soybean) | sdp4c.pk002.n23 (FIS) | CGS | 271 | 272 |
| ACBF Homolog (Soybean) | sgc6c.pk001.e12 (FIS) | CGS | 273 | 274 |
| ACBF Homolog (Soybean) | sgs2c.pk004.e8 (FIS) | CGS | 275 | 276 |
| ACBF Homolog (Soybean) | srr3c.pk001.e1 (FIS) | CGS | 277 | 278 |
| ACBF Homolog (Soybean) | ssl1c.pk005.i17 (FIS) | CGS | 279 | 280 |
| ACBF Homolog (Soybean) | ssm.pk0001.b11 (FIS) | CGS | 281 | 282 |
| ACBF Homolog (Wheat) | wdk3c.pk0003.a5 | FIS | 283 | 284 |
| ACBF Homolog (Wheat) | wlk1.pk0001.f8 | FIS | 285 | 286 |
| ACBF Homolog (Wheat) | wlm1.pk0008.c11 | FIS | 287 | 288 |
| ACBF Homolog (Wheat) | wlm96.pk030.m18 | FIS | 289 | 290 |
| TFIIA Large Subunit (Corn) | p0015.cdpfd14rb (FIS) | CGS | 291 | 292 |
| TFIIA Large Subunit (Corn) | p0115.clsmm93r (FIS) | CGS | 293 | 294 |
| TFIIA Large Subunit (Rice) | res1c.pk004.e6 (FIS) | CGS | 295 | 296 |
| TFIIA Large Subunit (Soybean) | sl2.pk0051.d3 (FIS) | CGS | 297 | 298 |
| TFIIA Large Subunit (Soybean) | ssl.pk0060.d4 (FIS) | CGS | 299 | 300 |
| TFIIA Large Subunit (Wheat) | wlmk8.pk0019.f6 | EST | 301 | 302 |
| TFIIA Small Subunit (Corn) | Contig of cen3n.pk0125.f12 p0015.cdpeg26r | CGS | 303 | 304 |
| TFIIA Small Subunit (Corn) | Contig of cco1.pk0047.h11 cen3n.pk0161.b5 | CGS | 305 | 306 |
| TFIIA Small Subunit (Rice) | rca1n.pk025.b22 (FIS) | CGS | 307 | 308 |
| TFIIA Small Subunit (Rice) | rlr24.pk0002.b3 (FIS) | CGS | 309 | 310 |
| TFIIA Small Subunit (Soybean) | Contig of se3.pk0033.a12 sfl1.pk0095.f11 | Contig | 311 | 312 |
| TFIIA Small Subunit (Soybean) | srr3c.pk002.n22 (FIS) | CGS | 313 | 314 |
| TFIIA Small Subunit (Wheat) | wdk2c.pk013.17 (FIS) | CGS | 315 | 316 |
| PITP (Barley) | bsh1.pk0008.b7 | FIS | 317 | 318 |
| PITP (Corn) | Contig of cr1n.pk0085.g2 | CGS | 319 | 320 |

TABLE 1-continued

Proteins Relating to Plant Gene Transcription, Metabolism, and Physiology

| Protein (Plant Source) | Clone Designation | Status | SEQ ID NO (Polynucleotide) | SEQ ID NO (Polypeptide) |
|---|---|---|---|---|
| | cs1.pk0082.c4 (FIS) | | | |
| | p0008.cb3ld47r | | | |
| | p0059.cmsbh07r | | | |
| | p0068.clsah90r | | | |
| | p0102.ceray51r | | | |
| | p0126.cnlbg89r | | | |
| PITP (Corn) | Contig of | Contig | 321 | 322 |
| | cpc1c.pk003.p15 | | | |
| | p0077.cpoab24r | | | |
| | p0077.cpoad67r | | | |
| | p0077.cpoaj21r | | | |
| PITP (Corn) | Contig of | CGS | 323 | 324 |
| | cpf1c.pk006.f21 | | | |
| | cr1n.pk0100.g9 | | | |
| | ctn1c.pk001.d19 | | | |
| | p0040.cftaa93r | | | |
| | p0097.cqrab20r | | | |
| | p0128.cpico20r | | | |
| PITP (Corn) | cta1n.pk0027.b9 | FIS | 325 | 326 |
| PITP (Corn) | Contig of | Contig | 327 | 328 |
| | cen3n.pk0053.d6 | | | |
| | cen3n.pk0058.h1 | | | |
| | cgs1c.pk002.h6 | | | |
| | p0075.cslag46r | | | |
| | p0083.clddi23r | | | |
| | p0098.cdfae47r | | | |
| | p0126.cnlaz32r | | | |
| PITP (Corn) | Contig of | Contig | 329 | 330 |
| | p0083.cldem48r | | | |
| | p0125.czaaj01r | | | |
| | p0128.cpiby92r | | | |
| PITP (Rice) | rlr2.pk0005.a12 | EST | 331 | 332 |
| PITP (Rice) | rlr2.pk0005.a12 (FIS) | CGS | 333 | 334 |
| PITP (Soybean) | Contig of | Contig | 335 | 336 |
| | sdp2c.pk026.i5 | | | |
| | se5.pk0029.b12 | | | |
| PITP (Soybean) | Contig of | Contig | 337 | 338 |
| | sdp3c.pk017.m12 | | | |
| | ses2w.pk0015.c12 | | | |
| PITP (Soybean) | ses2w.pk0015.c12 (FIS) | CGS | 339 | 340 |
| PITP (Soybean) | sfl1.pk0038.c9 | EST | 341 | 342 |
| PITP (Soybean) | Contig of | Contig* | 343 | 344 |
| | sfl1.pk0024.e2 | | | |
| | sfl1.pk0038.c9 (FIS) | | | |
| PITP (Soybean) | Contig of | Contig | 345 | 346 |
| | sgc7c.pk001.e20 | | | |
| | sgs2c.pk002.g7 | | | |
| | sr1.pk0051.e6 | | | |
| PITP (Soybean) | sls2c.pk001.i8 | FIS | 347 | 348 |
| PITP (Soybean) | ssm.pk0033.c10 | EST | 349 | 350 |
| PITP (Soybean) | ssm.pk0033.c10 (FIS) | CGS | 351 | 352 |
| PITP (Wheat) | wl1n.pk0024.g3 | FIS | 353 | 354 |
| PITP (Wheat) | Contig of | Contig | 355 | 356 |
| | wdk2c.pk013.e14 | | | |
| | wl1.pk0008.h10 | | | |
| | wl1.pk0012.b6 | | | |
| | wlm24.pk0031.c1 | | | |
| PITP (Wheat) | wr1.pk0068.h1 | FIS | 357 | 358 |
| PITP (Wheat) | wdk1c.pk012.j14 | EST | 359 | 360 |
| PITP (Wheat) | wle1.pk0002.c10 | EST | 361 | 362 |

Table 2 provides references to earlier U.S. Provisional Applications in which particular sequences in this application have been previously filed. For example, the first entry indicates that SEQ ID NOs:1 and 2 disclosed herein are SEQ ID NOs:5 and 6, respectively, in U.S. Provisional Application No. 60/172,958.

TABLE 2

Previously Filed Sequences in U.S. Provisional Applications

| SEQ ID NO. | Ser. No. | DuPont Docket No. | SEQ ID NO. |
|---|---|---|---|
| 1; 2 | 60/172958 | BB1421P1 | 5; 6 |
| 5; 6 | 60/172958 | BB1421P1 | 7; 8 |
| 7; 8 | 60/172958 | BB1421P1 | 9; 10 |
| 11; 12 | 60/172958 | BB1421P1 | 11; 12 |
| 15; 16 | 60/172958 | BB1421P1 | 13; 14 |
| 17; 18 | 60/172958 | BB1421P1 | 15; 16 |
| 19; 20 | 60/172958 | BB1421P1 | 17; 18 |
| 21; 22 | 60/172958 | BB1421P1 | 19; 20 |
| 25; 26 | 60/146511 | BB1387P1 | 1; 2 |
| 29; 30 | 60/146511 | BB1387P1 | 3; 4 |
| 33; 34 | 60/156006 | BB1400P1 | 1; 2 |
| 37; 38 | 60/156006 | BB1400P1 | 3; 4 |
| 39; 40 | 60/156006 | BB1400P1 | 5; 6 |
| 43; 44 | 60/156006 | BB1400P1 | 7; 8 |
| 47; 48 | 60/156006 | BB1400P1 | 9; 10 |
| 51; 52 | 60/156006 | BB1400P1 | 11; 12 |
| 55; 56 | 60/156006 | BB1400P1 | 13; 14 |
| 59; 60 | 60/156006 | BB1400P1 | 15; 16 |
| 61; 62 | 60/156006 | BB1400P1 | 17; 18 |
| 65; 66 | 60/156006 | BB1400P1 | 19; 20 |
| 69; 70 | 60/156006 | BB1400P1 | 21; 22 |
| 75; 76 | 60/156006 | BB1400P1 | 23; 24 |
| 79; 80 | 60/157287 | BB1411P1 | 1; 2 |
| 81; 82 | 60/157287 | BB1411P1 | 3; 4 |
| 83; 84 | 60/157287 | BB1411P1 | 5; 6 |
| 85; 86 | 60/157287 | BB1411P1 | 7; 8 |
| 87; 88 | 60/169767 | BB1415PRV | 1; 2 |
| 89; 90 | 60/169767 | BB1415PRV | 3; 4 |
| 93; 94 | 60/169767 | BB1415PRV | 5; 6 |
| 95; 96 | 60/169767 | BB1415PRV | 7; 8 |
| 99; 100 | 60/169767 | BB1415PRV | 9; 10 |
| 103; 104 | 60/169767 | BB1415PRV | 11; 12 |
| 105; 106 | 60/171054 | BB1412P1 | 1; 2 |
| 107; 108 | 60/171054 | BB1412P1 | 3; 4 |
| 109; 110 | 60/171054 | BB1412P1 | 5; 6 |
| 113; 114 | 60/171054 | BB1412P1 | 7; 8 |
| 117; 118 | 60/171054 | BB1412P1 | 9; 10 |
| 119; 120 | 60/171054 | BB1412P1 | 11; 12 |
| 121; 122 | 60/171054 | BB1412P1 | 13; 14 |
| 123; 124 | 60/171054 | BB1412P1 | 15; 16 |
| 127; 128 | 60/171515 | BB1431PRV | 1; 2 |
| 129; 130 | 60/171515 | BB1431PRV | 3; 4 |
| 131; 132 | 60/171515 | BB1431PRV | 5; 6 |
| 135; 136 | 60/171515 | BB1431PRV | 7; 8 |
| 139; 140 | 60/171515 | BB1431PRV | 9; 10 |
| 143; 144 | 60/171515 | BB1431PRV | 11; 12 |
| 147; 148 | 60/171515 | BB1431PRV | 13; 14 |
| 149; 150 | 60/171515 | BB1431PRV | 15; 16 |
| 151; 152 | 60/171515 | BB1431PRV | 17; 18 |
| 153; 154 | 60/171515 | BB1431PRV | 19; 20 |
| 155; 156 | 60/171515 | BB1431PRV | 21; 22 |
| 159; 160 | 60/171515 | BB1431PRV | 23; 24 |
| 161; 162 | 60/171515 | BB1431PRV | 25; 26 |
| 163; 164 | 60/171515 | BB1431PRV | 27; 28 |
| 167; 168 | 60/171515 | BB1431PRV | 29; 30 |
| 171; 172 | 60/171515 | BB1431PRV | 31; 32 |
| 175; 176 | 60/171515 | BB1431PRV | 33; 34 |
| 177; 178 | 60/173535 | BB1433PRV | 1; 2 |
| 179; 180 | 60/173535 | BB1433PRV | 3; 4 |
| 181; 182 | 60/173535 | BB1433PRV | 5; 6 |
| 183; 184 | 60/173535 | BB1433PRV | 7; 8 |
| 187; 188 | 60/173535 | BB1433PRV | 9; 10 |
| 191; 192 | 60/173535 | BB1433PRV | 11; 12 |
| 193; 194 | 60/173535 | BB1433PRV | 13; 14 |
| 317; 318 | 60/156899 | BB1398P1 | 1; 2 |
| 319; 320 | 60/156899 | BB1398P1 | 3; 4 |
| 325; 326 | 60/156899 | BB1398P1 | 5; 6 |
| 331; 332 | 60/156899 | BB1398P1 | 7; 8 |
| 337; 338 | 60/156899 | BB1398P1 | 9; 10 |
| 341; 342 | 60/156899 | BB1398P1 | 11; 12 |
| 349; 350 | 60/156899 | BB1398P1 | 13; 14 |
| 353; 354 | 60/156899 | BB1398P1 | 15; 16 |
| 355; 356 | 60/156899 | BB1398P1 | 17; 18 |
| 357; 358 | 60/156899 | BB1398P1 | 19; 20 |
| 359; 360 | 60/156899 | BB1398P1 | 21; 22 | cDNA clones encoding proteins involved in plant gene transcription, metabolism, and physiology were identified by conducting BLAST (Basic Local Alignment Search Tool; Altschul et al. (1993) *J. Mol. Biol.* 215:403-410) searches for similarity to sequences contained in the BLAST "nr" database (comprising all non-redundant GenBank ODS translations, sequences derived from the 3-dimensional structure Brookhaven Protein Data Bank, the last major release of the SWISS-PROT protein sequence database, EMBL, and DDBJ databases). The cDNA sequences obtained using methods such as those described in Example 3 were analyzed for similarity to all publicly available DNA sequences contained in the "nr" database using the BLASTN algorithm provided by the National Center for Biotechnology Information (NCBI). The DNA sequences were translated in all reading frames and compared for similarity to all publicly available protein sequences contained in the "nr" database using the BLASTX algorithm (Gish and States (1993) *Nat. Genet.* 3:266-272) provided by the NCBI. For convenience, the P-value (probability) of observing a match of a cDNA sequence to a sequence contained in the searched databases merely by chance as calculated by BLAST are reported herein as "pLog" values, which represent the negative of the logarithm of the reported P-value. Accordingly, the greater the pLog value, the greater the likelihood that the cDNA sequence and the BLAST "hit" represent homologous proteins.

The BLASTX search using the sequences from clones listed in Table 1 revealed similarity of the polypeptides encoded by the cDNAs to various proteins involved in gene transcription, metabolism, and physiology. Shown in Table 3 are the BLAST results for sequences enumerated in Table 1.

TABLE 3

BLAST Results for Sequences Encoding Polypeptides Homologous to Proteins Involved in Gene Transcription, Metabolism and Physiology

| SEQ ID NO: | Homologue Species | Homologue NCBI GenBank Identifier (GI) No. | BLAST pLog Value |
|---|---|---|---|
| 2 | Zea mays | 3746431 | 85.22 |
| 4 | Zea mays | 3746431 | >180.00 |
| 6 | Zea mays | 3746431 | 49.40 |
| 8 | Zea mays | 3695005 | 109.00 |
| 10 | Zea mays | 3695005 | >180.00 |
| 12 | Arabidopsis thaliana | 4049632 | 68.22 |
| 14 | Arabidopsis thaliana | 4049632 | >180.00 |
| 16 | Arabidopsis thaliana | 4049632 | 33.05 |
| 18 | Arabidopsis thaliana | 4049632 | 45.30 |
| 20 | Zea mays | 3695005 | 25.00 |
| 22 | Zea mays | 3695005 | 167.00 |
| 24 | Zea mays | 3695005 | >180.00 |
| 26 | Saccharomyces cerevisiae | 586407 | 8.70 |
| 28 | Saccharomyces cerevisiae | 586407 | 24.70 |
| 30 | Saccharomyces cerevisiae | 586407 | 9.00 |
| 32 | Saccharomyces cerevisiae | 586407 | 9.22 |
| 34 | Glycine max | 2739044 | 51.00 |

TABLE 3-continued

BLAST Results for Sequences Encoding Polypeptides Homologous to Proteins Involved in Gene Transcription, Metabolism and Physiology

| SEQ ID NO: | Homologue Species | Homologue NCBI GenBank Identifier (GI) No. | BLAST pLog Value |
|---|---|---|---|
| 36 | Glycine max | 2739044 | 129.00 |
| 38 | Glycine max | 2739044 | 38.70 |
| 40 | Glycine max | 2739044 | 69.52 |
| 42 | Glycine max | 7488694 | 144.00 |
| 44 | Glycine max | 2739044 | 59.30 |
| 46 | Glycine max | 2739044 | 131.00 |
| 48 | Glycine max | 2739044 | 79.22 |
| 50 | Glycine max | 2739044 | 136.00 |
| 52 | Glycine max | 2739046 | 51.30 |
| 54 | Glycine max | 7488696 | 66.70 |
| 56 | Glycine max | 2739044 | 103.00 |
| 58 | Glycine max | 2739044 | 135.00 |
| 60 | Glycine max | 2739046 | 73.70 |
| 62 | Glycine max | 2739044 | 24.70 |
| 64 | Glycine max | 2739044 | 136.00 |
| 66 | Glycine max | 2739044 | 16.15 |
| 68 | Glycine max | 7488694 | 130.00 |
| 70 | Glycine max | 2739044 | 30.70 |
| 72 | Glycine max | 2739044 | 131.00 |
| 74 | Glycine max | 7488696 | 19.00 |
| 76 | Glycine max | 2739046 | 38.10 |
| 78 | Glycine max | 7488696 | 21.30 |
| 80 | Ricinus communis | 1632831 | 62.70 |
| 82 | Ricinus communis | 1632831 | 45.52 |
| 84 | Ricinus communis | 1632831 | 65.70 |
| 86 | Arabidopsis thaliana | 4512684 | 60.70 |
| 88 | Synechocystis sp. | 1651828 | 69.04 |
| 90 | Synechocystis sp. | 1651828 | 58.70 |
| 92 | Arabidopsis thaliana | 7159282 | >180.00 |
| 94 | Synechocystis sp. | 1651828 | 79.04 |
| 96 | Synechocystis sp. | 1651828 | 29.05 |
| 98 | Arabidopsis thaliana | 7159282 | 123.00 |
| 100 | Synechocystis sp. | 1651828 | 80.52 |
| 102 | Arabidopsis thaliana | 7159282 | >180.00 |
| 104 | Synechocystis sp. | 1651828 | 105.00 |
| 106 | Homo sapiens | 432973 | 11.00 |
| 108 | Homo sapiens | 432973 | 10.70 |
| 110 | Homo sapiens | 432973 | 8.05 |
| 112 | Caenorhabditis elegans | 3881780 | 9.40 |
| 114 | Homo sapiens | 432973 | 10.00 |
| 116 | Bos taurus | 128383 | 10.40 |
| 118 | Homo sapiens | 432973 | 10.00 |
| 120 | Homo sapiens | 432973 | 10.52 |
| 122 | Homo sapiens | 432973 | 5.22 |
| 124 | Homo sapiens | 432973 | 10.52 |
| 126 | Caenorhabditis elegans | 3881780 | 10.70 |
| 128 | Arabidopsis thaliana | 4836698 | 43.04 |
| 130 | Arabidopsis thaliana | 4836698 | 42.30 |
| 132 | Oryza sativa | 3859568 | 37.40 |
| 134 | Oryza sativa | 3859568 | 75.10 |
| 136 | Oryza sativa | 3859570 | 30.40 |
| 138 | Oryza sativa | 3859570 | 35.00 |
| 140 | Arabidopsis thaliana | 3822216 | 64.30 |
| 142 | Arabidopsis thaliana | 3822216 | 64.22 |
| 144 | Oryza sativa | 3859570 | 60.52 |
| 146 | Oryza sativa | 3859570 | 60.52 |
| 148 | Oryza sativa | 3859570 | 59.52 |
| 150 | Arabidopsis thaliana | 3822216 | 38.52 |
| 152 | Oryza sativa | 3859570 | 61.30 |
| 154 | Arabidopsis thaliana | 4836698 | 55.15 |
| 156 | Arabidopsis thaliana | 3822216 | 66.05 |
| 158 | Arabidopsis thaliana | 3822216 | 66.05 |
| 160 | Arabidopsis thaliana | 3822216 | 27.70 |
| 162 | Arabidopsis thaliana | 4928751 | 59.00 |
| 164 | Arabidopsis thaliana | 4928751 | 59.00 |
| 166 | Arabidopsis thaliana | 4928751 | 59.00 |
| 168 | Arabidopsis thaliana | 4836698 | 46.52 |
| 170 | Arabidopsis thaliana | 4836698 | 41.70 |
| 172 | Oryza sativa | 3859570 | 18.15 |
| 174 | Oryza sativa | 3859570 | 56.00 |
| 176 | Oryza sativa | 3859570 | 87.10 |
| 178 | Homo sapiens | 5453930 | 25.00 |
| 180 | Homo sapiens | 5453930 | 35.40 |
| 182 | Homo sapiens | 5453930 | 28.40 |
| 184 | Homo sapiens | 5453930 | 34.00 |
| 186 | Homo sapiens | 5453930 | 37.40 |
| 188 | Homo sapiens | 5453930 | 37.15 |
| 190 | Homo sapiens | 5453930 | 37.22 |
| 192 | Homo sapiens | 5453930 | 23.04 |
| 194 | Homo sapiens | 5453930 | 34.40 |
| 196 | Homo sapiens | 5453930 | 37.30 |
| 198 | Stylosanthes hamata | 4099921 | 32.40 |
| 200 | Stylosanthes hamata | 4099921 | 38.10 |
| 202 | Stylosanthes hamata | 4099921 | 36.00 |
| 204 | Nicotiana tabacum | 4587373 | 43.30 |
| 206 | Stylosanthes hamata | 4099921 | 41.15 |
| 208 | Stylosanthes hamata | 4099921 | 41.00 |
| 210 | Arabidopsis thaliana | 3434973 | 36.10 |
| 212 | Arabidopsis thaliana | 4850382 | 33.52 |
| 214 | Arabidopsis thaliana | 7531110 | 41.22 |
| 216 | Arabidopsis thaliana | 7531110 | 38.70 |
| 218 | Stylosanthes hamata | 4099921 | 42.40 |
| 220 | Arabidopsis thaliana | 1903358 | 34.05 |
| 222 | Arabidopsis thaliana | 2289008 | 10.70 |
| 224 | Arabidopsis thaliana | 3075392 | 90.70 |
| 226 | Arabidopsis thaliana | 2289008 | 24.70 |
| 228 | Arabidopsis thaliana | 2289008 | 21.52 |
| 230 | Arabidopsis thaliana | 2459443 | 79.52 |
| 232 | Arabidopsis thaliana | 2459443 | 69.10 |
| 234 | Arabidopsis thaliana | 2459443 | 97.70 |
| 236 | Nicotiana tabacum | 1899188 | 104.00 |
| 238 | Nicotiana tabacum | 1899188 | 114.00 |
| 240 | Nicotiana tabacum | 1899188 | 99.00 |
| 242 | Nicotiana tabacum | 1899188 | 96.22 |
| 244 | Nicotiana tabacum | 1899188 | 102.00 |
| 246 | Nicotiana tabacum | 1899188 | 72.15 |
| 248 | Nicotiana tabacum | 1899188 | 120.00 |
| 250 | Nicotiana tabacum | 1899188 | 95.00 |
| 252 | Nicotiana tabacum | 1899188 | 105.00 |
| 254 | Nicotiana tabacum | 1899188 | 109.00 |
| 256 | Nicotiana tabacum | 1899188 | 93.52 |
| 258 | Nicotiana tabacum | 1899188 | 110.00 |
| 260 | Nicotiana tabacum | 1899188 | 109.00 |
| 262 | Nicotiana tabacum | 1899188 | 96.00 |
| 264 | Nicotiana tabacum | 1899188 | 101.00 |
| 266 | Nicotiana tabacum | 1899188 | 107.00 |
| 268 | Nicotiana tabacum | 1899188 | 109.00 |
| 270 | Nicotiana tabacum | 1899188 | 130.00 |
| 272 | Nicotiana tabacum | 1899188 | 147.00 |
| 274 | Nicotiana tabacum | 1899188 | 131.00 |
| 276 | Nicotiana tabacum | 1899188 | 111.00 |
| 278 | Nicotiana tabacum | 1899188 | 102.00 |
| 280 | Nicotiana tabacum | 1899188 | 133.00 |
| 282 | Nicotiana tabacum | 1899188 | 96.40 |
| 284 | Arabidopsis thaliana | 4835793 | 21.30 |
| 286 | Nicotiana tabacum | 1899188 | 69.52 |
| 288 | Nicotiana tabacum | 1899188 | 84.52 |
| 290 | Nicotiana tabacum | 1899188 | 68.00 |
| 292 | Arabidopsis thaliana | 2826884 | 97.52 |
| 294 | Arabidopsis thaliana | 2826884 | 101.00 |
| 296 | Arabidopsis thaliana | 2826884 | 96.15 |
| 298 | Arabidopsis thaliana | 2826884 | 130.00 |
| 300 | Arabidopsis thaliana | 2826884 | 133.00 |
| 302 | Arabidopsis thaliana | 2826884 | 10.30 |
| 304 | Arabidopsis thaliana | 2826882 | 45.00 |
| 306 | Arabidopsis thaliana | 2826882 | 54.00 |
| 308 | Arabidopsis thaliana | 2826882 | 44.00 |
| 310 | Arabidopsis thaliana | 2826882 | 46.70 |
| 312 | Arabidopsis thaliana | 2826882 | 46.15 |
| 314 | Arabidopsis thaliana | 2826882 | 50.40 |
| 316 | Arabidopsis thaliana | 2826882 | 46.70 |
| 318 | Arabidopsis thaliana | 4006913 | 127.00 |

TABLE 3-continued

BLAST Results for Sequences Encoding Polypeptides
Homologous to Proteins Involved in Gene Transcription,
Metabolism and Physiology

| SEQ ID NO: | Homologue Species | Homologue NCBI GenBank Identifier (GI) No. | BLAST pLog Value |
|---|---|---|---|
| 320 | *Arabidopsis thaliana* | 4006913 | 151.00 |
| 322 | *Arabidopsis thaliana* | 4567235 | 64.70 |
| 324 | *Arabidopsis thaliana* | 4567235 | 124.00 |
| 326 | *Arabidopsis thaliana* | 4006913 | 46.04 |
| 328 | *Arabidopsis thaliana* | 4567283 | 176.00 |
| 330 | *Arabidopsis thaliana* | 4006913 | 138.00 |
| 332 | *Arabidopsis thaliana* | 4006913 | 148.00 |
| 334 | *Arabidopsis thaliana* | 4914429 | >180.00 |
| 336 | *Arabidopsis thaliana* | 4914429 | 72.70 |
| 338 | *Arabidopsis thaliana* | 3096927 | 133.00 |
| 340 | *Arabidopsis thaliana* | 4914429 | >180.00 |
| 342 | *Arabidopsis thaliana* | 4006913 | 90.10 |
| 344 | *Arabidopsis thaliana* | 4874285 | 117.00 |
| 346 | *Arabidopsis thaliana* | 7267559 | 71.70 |
| 348 | *Arabidopsis thaliana* | 4914429 | 26.30 |
| 350 | *Arabidopsis thaliana* | 3953470 | 57.70 |
| 352 | *Arabidopsis thaliana* | 4914429 | >180.00 |
| 354 | *Arabidopsis thaliana* | 4567283 | 84.22 |
| 356 | *Arabidopsis thaliana* | 4006913 | 102.00 |
| 358 | *Arabidopsis thaliana* | 3953470 | 74.00 |
| 360 | *Arabidopsis thaliana* | 3953470 | 6.22 |
| 362 | *Oryza sativa* | 5257268 | 2.70 |

NCBI GenBank Identifier (GI) Nos. 3746431, 3695005, and 4049632 are amino acid sequences of pyruvate dehydrogenase kinase; NCBI GI No. 586407 is the amino acid sequence of *Saccharomyces cerevisiae* RFT1 protein; NCBI GI Nos. 2739044, 7488694, 2739046, and 7488696 are amino acid sequences of phosphoinositide binding protein; NCBI GI Nos. 1632831 and 4512684 are multiprotein bridging factor amino acid sequences; NCBI GI Nos. 1651828 and 7159282 are dihydrolipoamide dehydrogenase amino acid sequences; NCBI GI Nos. 432973, 3881780, and 128383 are peroxisomal lipid transfer protein amino acid sequences; NCBI GI Nos. 4836698, 3822216, and 4928751 are amino acid sequences of different YABBY transcription factors; NCBI GI Nos. 3859568 and 3859570 are amino acid sequences of YABBY transcription factor homologs; NCBI GI No. 5453930 is RNA polymerase II subunit RPB9 amino acid sequence; NCBI GI Nos. 3434973, 4587373 and 7531110 are EREBP amino acid sequences; NCBI GI Nos. 4099921, 4850382, and 1903358 are EREBP homolog amino acid sequences; NCBI GI Nos. 2289008 and 3075392 are 3-beta-hydroxysteroid dehydrogenase amino acid sequences; NCBI GI No. 2459443 is steroid dehydrogenase amino acid sequence; NCBI GI No. 1899188 is ACBF amino acid sequence; NCBI GI No. 4835793 is ACBF homolog amino acid sequence; NCBI GI No. 2826884 is TFIIA large subunit amino acid sequence; NCBI GI No. 2826882 is TFIIA small subunit amino acid sequence; and NCBI GenBank Identifier GI Nos. 4006913, 4567235, 4567283, 4914429, 3096927, 4874285, 7267559, 5257268, and 3953470 are PITP amino acid sequences.

FIGS. 1A-1B depict the amino acid sequence alignment of the pyruvate dehydrogenase kinase sequences set forth in SEQ ID NOs:4, 10, 14, and 24, and the *Zea mays* pyruvate dehydrogenase kinase sequence (NCBI GenBank Identifier (GI) No. 3695005; SEQ ID NO:363). SEQ ID NOs: 4, 10, 14, and 24 exhibit 81%, 90%, 72%, and 87% identity, respectively, with SEQ ID NO:363.

FIGS. 2A-2C depict the amino acid sequence alignment of the phosphoinositide binding protein sequences set forth in SEQ ID NOs:36, 42, 46, 50, 58, 64, 68, and 72, and the *Glycine max* phosphoinositide binding protein sequence (NCBI GenBank Identifier (GI) No. 2739044; SEQ ID NO:364). SEQ ID NOs:36, 42, 46, 50, 58, 64, 68, and 72 exhibit 67%, 75%, 66%, 67%, 67%, 67%, 67%, and 64% identity, respectively, with SEQ ID NO:364.

FIG. 2D depicts the amino acid sequence alignment of the phosphoinositide binding protein sequence set forth in SEQ ID NO:54 and the *Glycine max* phosphoinositide binding protein sequence (NCBI GenBank Identifier (GI) No. 2739046; SEQ ID NO:365). SEQ ID NO:54 exhibits 45% identity with SEQ ID NO:365.

FIG. 3 depicts the amino acid sequence alignment of the multiprotein bridging factor sequences set forth in SEQ ID NOs:80, 82, 84, and 86, and the *Ricinus communis* multiprotein bridging factor sequence (NCBI GenBank Identifier (GI) No. 1632831; SEQ ID NO:366). SEQ ID NOs:80, 82, 84, and 86 exhibit 81%, 62%, 85%, and 78% identity, respectively, with SEQ ID NO:366.

FIGS. 4A-4B depict the amino acid sequence alignment of the dihydrolipoamide dehydrogenase sequences set forth in SEQ ID NOs:92 and 102, and the *Arabidopsis thaliana* dihydrolipoamide dehydrogenase sequence (NCBI GenBank Identifier (GI) No. 7159282; SEQ ID NO:367). SEQ ID NOs: 92 and 102 exhibit 75% and 80% identity, respectively, with SEQ ID NO:367.

FIGS. 5A-5B depict the amino acid sequence alignment of the peroxisomal lipid transfer protein sequences set forth in SEQ ID NOs:106, 108, 110, 112, 114, 116, 118, 120, 124, and 126, and the *Homo sapiens* peroxisomal lipid transfer protein sequence (NCBI GenBank Identifier (GI) No. 432973; SEQ ID NO:368). SEQ ID NOs:106, 108, 110, 112, 114, 116, 118, 120, 124, and 126 exhibit 28%, 26%, 25%, 26%, 27%, 27%, 24%, 28%, 25% and 26% identity, respectively, with SEQ ID NO:368.

FIGS. 6A-6D depict the amino acid sequence alignment of the YABBY transcription factor sequences set forth in SEQ ID NOs:128, 130, 134, 138, 140, 142, 144, 146, 148, 152, 154, 156, 158, 162, 164, 166, 170, 174, and 176, and the *Arabidopsis thaliana* YABBY transcription factor sequence (NCBI GenBank Identifier (GI) No. 4836698; SEQ ID NO:369). SEQ ID NOs:128, 130, 134, 138, 140, 142, 144, 146, 148, 152, 154, 156, 158, 162, 164, 166, 170, 174, and 176 exhibit 45%, 47%, 36%, 20%, 38%, 38%, 35%, 35%, 37%, 36%, 59%, 35%, 35%, 37%, 34%, 34%, 45%, 37%, and 34% identity, respectively, with SEQ ID NO:369.

FIGS. 7A-7B depict the amino acid sequence alignment of the RNA polymerase II subunit RPB9 sequences set forth in SEQ ID NOs:178, 180, 182, 186, 188, 190, 192, 194, and 196, and the Homo sapiens RNA polymerase II subunit RPB9 sequence (NCBI GenBank Identifier (GI) No. 5453930; SEQ ID NO:370). SEQ ID NOs:178, 180, 182, 186, 188, 190, 192, 194, and 196 exhibit 41%, 53%, 42%, 55%, 53%, 53%, 35%, 51 %, and 53% identity, respectively, with SEQ ID NO:370.

FIGS. 8A-8D depict the amino acid sequence alignment of the EREBP homolog sequences set forth in SEQ ID NOs:200, 202, 204, 206, 208, 212, 214, 216, 218, and 220, and the *Stylosanthes hamata* EREBP homolog sequence (NCBI GenBank Identifier (GI) No. 4099921; SEQ ID NO:371). SEQ ID NOs:200, 202, 204, 206, 208, 212, 214, 216, 218, and 220 exhibit 38%, 39%, 29%, 40%, 41 %, 27%, 39%, 39%, 39%, and 32% identity, respectively, with SEQ ID NO:371.

FIGS. 9A-9J depict the amino acid sequence alignment of the ACBF homolog sequences set forth in SEQ ID NOs:236, 238, 240, 242, 248, 250, 252, 254, 258, 268, 270, 272, 274, 276, 278, 280, and 282, and the *Nicotiana tabacum* ACBF sequence (NCBI GenBank Identifier (GI) No. 1899188; SEQ ID NO:372). SEQ ID NOs:236, 238, 240, 242, 248, 250, 252, 254, 258, 268, 270, 272, 274, 276, 278, 280, and 282 exhibit 45%, 50%, 44%, 41%, 48%, 41%, 42%, 44%, 48%, 49%, 54%, 57%, 52%, 48%, 44%, 60%, and 41% identity, respectively, with SEQ ID NO:372.

FIGS. 10A-10C depict the amino acid sequence alignment of the TFIIA large subunit sequences set forth in SEQ ID NOs:292, 294, 296, 298, and 300, and the *Arabidopsis thaliana* TFIIA large subunit sequence (NCBI Gen Bank Identifier (GI) No. 2826884; SEQ ID NO:373). SEQ ID NOs: 292, 294, 296, 298, and 300 exhibit 44%, 45%, 44%, 57%, and 57% identity, respectively, with SEQ ID NO:373.

FIG. 11 depicts the amino acid sequence alignment of the TFIIA small subunit sequences set forth in SEQ ID NOs:304, 306, 308, 310, 314, and 316, and the *Arabidopsis thaliana* TFIIA small subunit sequence (NCBI GenBank Identifier (GI) No. 2826882; SEQ ID NO:374). SEQ ID NOs:304, 306, 308, 310, 314, and 316 exhibit 83%, 83%, 79%, 85%, 92%, and 84% identity, respectively, with SEQ ID NO:374.

FIGS. 12A-12D depict the amino acid sequence alignment of the PITP sequences set forth in SEQ ID NOs:320, 324, 334, 340, and 352, and the *Arabidopsis thaliana* PITP sequence (NCBI GenBank Identifier (GI) No. 4914429; SEQ ID NO:375). SEQ ID NOs:320, 324, 334, 340, and 352 exhibit 51%, 50%, 53%, 69%, and 58% identity, respectively, with SEQ ID NO:375.

In the above Figures amino acids which are conserved among all and at least two sequences with an amino acid at that position are indicated with an asterisk (*) Dashes are used by the Megalign program to maximize alignment of the sequences. Sequence alignments and percent identity calculations were performed using the Megalign program of the LASERGENE bioinformatics computing suite (DNASTAR Inc., Madison, Wis.). Multiple alignment of the sequences was performed using the Clustal method of alignment (Higgins and Sharp (1989) CABIOS. 5:151-153) with the default parameters (GAP PENALTY=10, GAP LENGTH PENALTY=10). Default parameters for pairwise alignments using the Clustal method were KTUPLE 1, GAP PENALTY=3, WINDOW=5 and DIAGONALS SAVED=5.

B. Exemplary Utility of the Present Invention

The present invention provides utility in such exemplary applications as: engineering cell cycle progression, stress/pathogen response, protein/lipid transport, general level of gene expression and transcription, fatty acid and lipid levels, respiration levels, level of transcription regulated by specific transcription factors (YABBY, EREBP, and ACBF families of transcription factors), flower and carpel development, yield, biomass production, steroid hormone biosynthesis and responses, response to ethylene, vascular system-specific gene expression, isoflavone biosynthesis.

C. Exemplary Preferable Embodiments

While the various preferred embodiments are disclosed throughout the specification, exemplary preferable embodiments include the following: (i) cDNA libraries representing mRNAs from various barley (*Hordeum vulgare*), African daisy (*Dimorphotheca sinuata*), *Eucalyptus tereticornis*, para rubber (*Hevea brasiliensis*), cattail (*Typha latifolia*), Jerusalem artichoke (*Helianthus tuberosus*), Florida bitterbush (*Picramnia pentandra*), grape (*Vitis* sp.), vernonia (*Vernonia mespilifolia*), corn (*Zea mays*), rice (*Oryza sativa*), soybean (*Glycine max*), and wheat (*Triticum aestivum*) tissues were prepared. The characteristics of the libraries are described below.

TABLE 4 cDNA Libraries from Barley, African Daisy, *Eucalyptus tereticornis*, Para Rubber, Cattail, Jerusalem Artichoke, Florida Bitterbush, Grape, *Vernonia*, Corn[1], Rice, Soybean, and Wheat

| Library | Tissue | Clone |
|---------|--------|-------|
| bsh1 | Barley Sheath, Developing Seedling | bsh1.pk0008.b7 |
| | | bsh1.pk0013.c3 |
| cbn10 | Corn Developing Kernel (Embryo and Endosperm); 10 Days After Pollination | cbn10.pk0004.d5 |
| | | cbn10.pk0004.g11 |
| | | cbn10.pk0007.c6 |
| | | cbn10.pk0049.f10 |
| | | cbn10.pk0061.d5 |
| cbn2n | Corn Developing Kernel Two Days After Pollination[2] | cbn2n.pk0002.h2 |
| cc1 | Corn Undifferentiated Callus | cc1.pk0026.b9 |
| cca | Corn Callus Type II Tissue, Undifferentiated, Highly Transformable | cca.pk0025.f4 |
| ccase-b | Corn Callus Type II Tissue, Somatic Embryo Formed, Highly Transformable | ccase-b.pk0001.b2 |
| | | ccase-b.pk0002.d5 |
| cco1 | Corn Cob of 67 Day Old Plants Grown in Green House | cco1.pk0040.f2 |
| | | cco1.pk0047.h11 |
| cco1n | Corn Cob of 67 Day Old Plants Grown in Green House[2] | cco1n.pk0006.d9 |
| | | cco1n.pk0037.c3 |
| | | cco1n.pk054.k9 |
| | | cco1n.pk054.n4 |
| | | cco1n.pk071.f24 |
| | | cco1n.pk080.g6 |
| | | cco1n.pk087.j16 |
| cdo1c | Corn Ovary (Including Pedicel and Glumes), 5 Days After Silking | cdo1c.pk002.a17 |
| ceb1 | Corn Embryo 10 to 11 Days After Pollination | ceb1.pk0039.e7 |
| | | ceb1.pk0094.e9 |
| ceb7f | Corn Embryo 15 to 30 Days After Pollination | ceb7f.pk003.n22 |
| cen1 | Corn Endosperm 10 to 11 Days After Pollination | cen1.pk0045.a8 |

TABLE 4-continued cDNA Libraries from Barley, African Daisy, *Eucalyptus tereticornis*,
Para Rubber, Cattail, Jerusalem Artichoke, Florida Bitterbush,
Grape, *Vernonia*, Corn[1], Rice, Soybean, and Wheat

| Library | Tissue | Clone |
|---|---|---|
| cen3n | Corn Endosperm 20 Days After Pollination[2] | cen3n.pk0053.d6 |
| | | cen3n.pk0058.h1 |
| | | cen3n.pk0095.g7 |
| | | cen3n.pk0125.f12 |
| | | cen3n.pk0144.e11 |
| | | cen3n.pk0151.g4 |
| | | cen3n.pk0161.b5 |
| | | cen3n.pk0178.e9 |
| ces1f | Corn Immature Ear Shoot, V19 | ces1f.pk004.i17 |
| cgs1c | Corn Sepal Tissue at Meiosis About 14 to 16 Days After Emergence (Site of Proline Synthesis That Supports Pollen Development) | cgs1c.pk002.h6 |
| chpc8 | Corn (MBS847) 8 Day Old Shoot Treated 8 Hours With Herbicide[3]. | chpc8.pk0001.a11 |
| | | chpc8.pk0003.c2 |
| cpc1c | Corn Pooled BMS Treated With Chemicals Related to cGMP[4] | cpc1c.pk003.p15 |
| | | cpd1c.pk012.a12 |
| cpe1c | Corn Pooled BMS Treated With Chemicals Related to Phosphatase[5] | cpe1c.pk001.m16 |
| | | cpe1c.pk011.d2 |
| cpf1c | Corn Pooled BMS Treated With Chemicals Related to Protein Synthesis[6] | cpf1c.pk001.a4 |
| | | cpf1c.pk006.f21 |
| cph1c | Corn Pooled BMS Treated With Chemicals Related to Redox Ratio[7] | cph1c.pk001.o15 |
| cpi1c | Corn Pooled BMS Treated with Chemicals Related to Biochemical Compound Synthesis[8] | cpi1c.pk015.g7 |
| cpj1c | Corn Pooled BMS Treated With Chemicals Related to Membrane Ionic Force[9] | cpj1c.pk001.m24 |
| | | cpj1c.pk004.g16 |
| cr1 | Corn Root From 7 Day Old Seedlings | cr1.pk0011.c1 |
| cr1bio | Corn Root From 7 Day Old Seedlings Grown in Light[2] | cr1bio.pk0006.d6 |
| cr1n | Corn Root From 7 Day Old Seedlings[2] | cr1n.pk0029.g1 |
| | | cr1n.pk0030.g6 |
| | | cr1n.pk0085.g2 |
| | | cr1n.pk0097.e12 |
| | | cr1n.pk0100.g9 |
| | | cr1n.pk0113.c3 |
| cs1 | Corn Leaf Sheath From 5 Week Old Plant | cs1.pk0082.c4 |
| csh3c | Corn Shoots and Roots Sprayed with Herbicide[10] | csh3c.pk001.n24 |
| csi1 | Corn Silk | csi1.pk0013.g3 |
| csi1n | Corn Silk[2] | csi1n.pk0031.b7 |
| | | csi1n.pk0049.h2 |
| cta1n | Corn Tassel[2] | cta1n.pk0027.b9 |
| ctn1c | Corn Tassel, Night Harvested | ctn1c.pk001.d19 |
| dms1c | African Daisy Developing Seed | dms1c.pk001.p5 |
| eef1c | *Eucalyptus tereticornis* Flower Buds From Adult Tree | eef1c.pk005.c14 |
| | | eef1c.pk007.h7 |
| ehb2c | Para Rubber Tree (PR255) Latex Tapped in 2nd Day of 3 Day Tapping Cycle | ehb2c.pk006.f22 |
| | | ehb2c.pk013.n19 |
| etr1c | Cattail Root | etr1c.pk011.p10 |
| he1 | Jerusalem Artichoke Tuber | he1.pk0013.c8 |
| p0005 | Corn Immature Ear | p0005.cbmei53r |
| | | p0005.cbmfb43r |
| p0008 | Corn Leaf, 3 Weeks Old | p0008.cb3ld47r |
| p0015 | Corn Embryo 13 Days After Pollination | p0015.cdpeg26r |
| | | p0015.cdpfd14rb |
| p0016 | Corn Tassel Shoots, Pooled, 0.1-1.4 cm | p0016.ctsad33r |
| | | p0016.ctsbz78r |
| p0018 | Corn Seedling After 10 Day Drought, Heat Shocked for 24 Hours, Harvested After Recovery at Normal Growth Conditions for 8 Hours | p0018.chssr46rb |
| | | p0018.chstf54r |
| p0039 | Corn Vegetative Meristem | p0039.cvmag51r |
| p0040 | Corn Tassel | p0040.cftaa93r |
| p0041 | Corn Root Tips Smaller Than 5 mm in Length Four Days After Imbibition | p0041.crtap01r |
| p0052 | Corn Cob Before Pollination, Some Pedicel and Kernel Material Present | p0052.ckhah16r |
| | | p0052.ckhak16r |
| p0059 | Corn Scutelar Node from Seeds Two and Three Days After Germination | p0059.cmsbh07r |
| p0068 | Corn Pericarp 28 Days After Pollination | p0068.clsah90r |
| p0075 | Corn Shoot And Leaf Material From Dark-Grown 7 Day-Old Seedlings | p0075.cslag46r |
| p0077 | Pollen From Corn GS3 Plants | p0077.cpoab24r |
| | | p0077.cpoad67r |
| | | p0077.cpoaj21r |

TABLE 4-continued cDNA Libraries from Barley, African Daisy, *Eucalyptus tereticornis*,
Para Rubber, Cattail, Jerusalem Artichoke, Florida Bitterbush,
Grape, *Vernonia*, Corn[1], Rice, Soybean, and Wheat

| Library | Tissue | Clone |
|---|---|---|
| p0081 | Corn Pedicel 10 Days After Pollination | p0081.chcaa15r |
| p0083 | Corn Whole Kernels 7 Days After Pollination | p0083.cldau06r |
| | | p0083.cldaz94r |
| | | p0083.clddg64r |
| | | p0083.clddi23r |
| | | p0083.clddl26r |
| | | p0083.cldem48r |
| | | p0083.clder38rb |
| p0094 | Corn Leaf Collars for the Ear Leaf (EL), and the Next Leaf Above and Below the EL; Growth Conditions: Field; Control or Untreated Tissues[2] | p0094.csstb82r |
| p0095 | Corn Ear Leaf Sheath; Growth Conditions: Field; Control or Untreated Tissues; Growth Stage: 2-3 weeks After Pollen Shed[2] | p0095.cwsas06r |
| p0097 | Corn V9 Whorl Section (7 cm) From Plant Infected Four Times With European Corn Borer | p0097.cqrab20r |
| p0098 | Ear Shoot, Prophase I (2.8-4.8 cm)[2] | p0098.cdfae47r |
| p0102 | Corn Early Meiosis Tassels[2] | p0102.ceray51r |
| p0104 | Corn Roots V5, Corn Root Worm Infested[2] | p0104.cabak40r |
| p0107 | Corn Whole Kernels 7 Days After Pollination[2] | p0107.cbcaq06r |
| p0109 | Corn Leaves From Les9 Mutant; Pool of Les9 Transition Zone + Les9 Mature Lesions[2] | p0109.cdadd47r |
| p0115 | Corn Leaf and Sheath Meristem Tissue Collected from 10th, 11th, and 12th Leaves[2] | p0115.clsmm93r |
| p0116 | DAM Methylase Induced Transgenic Corn BMS Suspension Cells[2] | p0116.cesaj63r |
| p0118 | Corn Stem Tissue Pooled From the 4-5 Internodes Subtending The Tassel At Stages V8-V12, Night Harvested[2] | p0118.chsbm24r |
| p0125 | Corn Anther Prophase I[2] | p0125.czaaj01r |
| p0126 | Corn Leaf Tissue From V8-V10 Stages, Pooled, Night-Harvested | p0126.cnlaz32r |
| | | p0126.cnlbg89r |
| | | p0126.cnldd44r |
| p0127 | Corn Nucellus Tissue, 5 Days After Silking[2] | p0127.cntak21r |
| | | p0127.cntbd60r |
| p0128 | Corn Primary and Secondary Immature Ear | p0128.cpibn44r |
| | | p0128.cpiby92r |
| | | p0128.cpicc94r |
| | | p0128.cpico20r |
| p0134 | Regenerating Corn Hi-II 223a, 1129e Callus 10 Days and 14 Days After Auxin Removal | p0134.carab02r |
| pps | Developing Seeds of Florida Bitterbush | pps.pk0007.h8 |
| rca1c | Rice Nipponbare Callus | rca1c.pk0004.d10 |
| rca1n | Rice Callus[2] | rca1n.pk012.b24 |
| | | rca1n.pk025.b22 |
| | | rca1n.pk027.i5 |
| rdr1f | Rice Developing Root of 10 Day Old Plant | rdr1f.pk001.f2 |
| rds1c | Rice Developing Seed | rds1c.pk006.a3 |
| | | rds1c.pk007.h14 |
| rds2c | Rice Developing Seed From Middle of the Plant | rds2c.pk004.h9 |
| | | rds2c.pk005.e5 |
| | | rds2c.pk006.b20 |
| | | rds2c.pk008.o15 |
| rds3c | Rice Developing Seed From Top of the Plant | rds3c.pk001.b10 |
| res1c | Rice Etiolated Seedling | res1c.pk004.e6 |
| rl0n | Rice 15 Day Old Leaf[2] | rl0n.pk0031.e10 |
| | | rl0n.pk096.h12 |
| | | rl0n.pk096.k13 |
| rlm1n | Rice Leaf 15 Days After Germination Harvested 2-72 Hours Following Infection With *Magnaporta grisea* (4360-R-62 and 4360-R-67)[2] | rlm1n.pk001.e13 |
| rlr12 | Resistant Rice Leaf 15 Days After Germination, 12 Hours After Infection of Strain *Magnaporthe grisea* 4360-R-62 (AVR2-YAMO) | rlr12.pk0013.h12 |
| rlr2 | Resistant Rice Leaf 15 Days After Germination, 2 Hours After Infection of Strain *Magnaporthe grisea* 4360-R-62 (AVR2-YAMO) | rlr2.pk0005.a12 |
| rlr24 | Resistant Rice Leaf 15 Days After Germination, 24 Hours After Infection of Strain *Magnaporthe grisea* 4360-R-62 (AVR2-YAMO) | rlr24.pk0002.b3 |
| | | rlr24.pk0080.b1 |

TABLE 4-continued cDNA Libraries from Barley, African Daisy, *Eucalyptus tereticornis*,
Para Rubber, Cattail, Jerusalem Artichoke, Florida Bitterbush,
Grape, *Vernonia*, Corn[1], Rice, Soybean, and Wheat

| Library | Tissue | Clone |
| --- | --- | --- |
| rlr48 | Resistant Rice Leaf 15 Days After Germination, 48 Hours After Infection of Strain *Magnaporthe grisea* 4360-R-62 (AVR2-YAMO) | rlr48.pk0014.a12 |
| rls12 | Susceptible Rice Leaf 15 Days After Germination, 12 hours After Infection of Strain *Magnaporthe grisea* 4360-R-67 (AVR2-YAMO) | rls12.pk0001.d2 |
| rls48 | Susceptible Rice Leaf 15 Days After Germination, 48 Hours After Infection of Strain *Magnaporthe grisea* 4360-R-67 (AVR2-YAMO) | rls48.pk0018.d5 |
| rls6 | Susceptible Rice Leaf 15 Days After Germination, 6 Hours After Infection of Strain *Magnaporthe grisea* 4360-R-67 (AVR2-YAMO) | rls6.pk0062.d5 rls6.pk0076.e6 rls6.pk0077.c1 |
| rr1 | Rice Root of Two Week Old Developing Seedling | rr1.pk0027.f11 rr1.pk0068.d6 rr1.pk078.c2 rr1.pk079.o4 rr1.pk098.p24 |
| rsl1n | Rice 15-Day-Old Seedling[2] | rsl1n.pk002.f6 rsl1n.pk010.j9 rsl1n.pk010.l3 |
| rsr9n | Rice Leaf 15 Days After Germination Harvested 2-72 Hours Following Infection With *Magnaporta grisea* (4360-R-62 and 4360-R-67)[2] | rsr9n.pk001.c9 rsr9n.pk002.i20 |
| sah1c | Soybean Sprayed With Authority ™ Herbicide | sah1c.pk004.c9 |
| scn1c | Soybean Embryogenic Suspension Culture Collected 10 Months Old (Necrotic Tissue) | scn1c.pk001.i15 |
| scr1c | Soybean Embryogenic Suspension Culture Subjected to 4 Vacuum Cycles and Collected 12 Hrs Later | scr1c.pk002.k6 |
| sdp2c | Soybean Developing Pod (6-7 mm) | sdp2c.pk026.i5 |
| sdp3c | Soybean Developing Pod (8-9 mm) | sdp3c.pk006.m7 sdp3c.pk017.m12 |
| sdp4c | Soybean Developing Pod (10-12 mm) | sdp4c.pk002.n23 sdp4c.pk006.h12 |
| se1 | Soybean Embryo, 6 to 10 Days After Flowering | se1.pk0003.d4 se1.pk0029.g11 |
| se3 | Soybean Embryo, 17 Days After Flowering | se3.pk0033.a12 |
| se5 | Soybean Embryo, 21 Days After Flowering | se5.pk0029.b12 |
| ses2w | Soybean Embryogenic Suspension 2 Weeks After Subculture | ses2w.pk0013.d6 ses2w.pk0015.c12 |
| sfl1 | Soybean Immature Flower | sfl1.pk0024.e2 sfl1.pk0034.f3 sfl1.pk0038.c9 sfl1.pk0060.f3 sfl1.pk0074.g3 sfl1.pk0095.f11 sfl1.pk131.f9 |
| sfl1n | Soybean Immature Flower[2] | sfl1n.pk001.d4 |
| sfl1n1 | Soybean Immature Flower[2] | sfl1n1.pk001.o20 |
| sgc2c | Soybean Cotyledon 12-20 Days After Germination (Mature Green) | sgc2c.pk001.o9 |
| sgc6c | Soybean Cotyledon 16-26 Days After Germination (All Yellow) | sgc6c.pk001.e12 |
| sgc7c | Soybean Cotyledon 18-30 Days After Germination (Yellow and Wilting) | sgc7c.pk001.e20 |
| sgs2c | Soybean Seed 14 Hours After Germination | sgs2c.pk002.g7 sgs2c.pk003.n17 sgs2c.pk004.e8 sgs2c.pk004.h19 sgs2c.pk004.k10 |
| sl2 | Soybean Two-Week-Old Developing Seedling Treated With 2.5 ppm Chlorimuron | sl2.pk0051.d3 sl2.pk131.h2 |
| sls1c | Soybean (variety S1990) Infected With *Sclerotinia sclerotiorum* Mycelium | sls1c.pk008.p15 sls1c.pk023.d12 |
| sls2c | Soybean (variety Manta) Infected With *Sclerotinia sclerotiorum* Mycelium | sls2c.pk001.i8 |
| sml1c | Soybean Mature Leaf | sml1c.pk001.m24 |
| sr1 | Soybean Root | sr1.pk0016.d3 sr1.pk0051.e6 |

TABLE 4-continued cDNA Libraries from Barley, African Daisy, *Eucalyptus tereticornis*,
Para Rubber, Cattail, Jerusalem Artichoke, Florida Bitterbush,
Grape, *Vernonia*, Corn[1], Rice, Soybean, and Wheat

| Library | Tissue | Clone |
|---|---|---|
| src2c | Soybean 8 Day Old Root Infected With Eggs of Cyst Nematode (*Heteroderea glycensis*) (Race 1) for 4 Days | src2c.pk002.o23 |
| src3c | Soybean 8 Day Old Root Infected With Cyst Nematode | src3c.pk011.h11 |
| srr3c | Soybean 8-Day-Old Root | srr3c.pk001.e1 |
|  |  | srr3c.pk002.n22 |
| ssl | Soybean Seedling 5-10 Days After Germination | ssl.pk0060.d4 |
| ssl1c | Soybean (Transgenic High Lysine Line 5403-218) Seed 25 Days After Fertilization | ssl1c.pk002.k23 |
|  |  | ssl1c.pk005.i17 |
| ssm | Soybean Shoot Meristem | ssm.pk0001.b11 |
|  |  | ssm.pk0020.f6 |
|  |  | ssm.pk0033.c10 |
| vdb1c | Grape Developing Bud | vdb1c.pk009.b9 |
|  |  | vdb1c.pk010.j20 |
| vs1n | *Vernonia* Seed[2] | vs1n.pk013.j18 |
|  |  | vs1n.pk014.n9 |
| wdk1c | Wheat Developing Kernel, 3 Days After Anthesis | wdk1c.pk012.j14 |
| wdk2c | Wheat Developing Kernel, 7 Days After Anthesis | wdk2c.pk0004.c5 |
|  |  | wdk2c.pk007.c14 |
|  |  | wdk2c.pk013.e14 |
|  |  | wdk2c.pk013.17 |
|  |  | wdk2c.pk017.c19 |
|  |  | wdk2c.pk017.c3 |
| wdk3c | Wheat Developing Kernel, 14 Days After Anthesis | wdk3c.pk0003.a5 |
|  |  | wdk3c.pk006.d12 |
|  |  | wdk3c.pk012.h14 |
| wdk9n | Wheat Kernels 3, 7, 14 and 21 Days After Anthesis | wdk9n.pk001.p2 |
| wdk9n1 | Wheat Kernels 3, 7, 14 and 21 Days After Anthesis[2] | wdk9n1.pk001.n20 |
| wdr1f | Wheat Developing Root | wdr1f.pk003.15 |
| wkm2n | Wheat Kernel Malted 175 Hours at 4° C.[2] | wkm2n.pk008.p10 |
| wl1 | Wheat Leaf From 7 Day Old Seedling Light Grown | wl1.pk0008.h10 |
|  |  | wl1.pk0012.b6 |
| wl1n | Wheat Leaf From 7 Day Old Seedling Light Grown[2] | wl1n.pk0024.g3 |
|  |  | wl1n.pk0102.e9 |
| wle1 | Wheat Leaf From 7 Day Old Etiolated Seedling | wle1.pk0003.a8 |
|  |  | wle1.pk0002.c10 |
| wle1n | Wheat Leaf From 7 Day Old Etiolated Seedling[2] | wle1n.pk0004.d6 |
|  |  | wle1n.pk0043.a10 |
|  |  | wle1n.pk0058.f3 |
| wlk1 | Wheat Seedling 1 Hour After Treatment With Herbicide[11] | wlk1.pk0001.f8 |
| wlm0 | Wheat Seedling 0 Hour After Inoculation With *Erysiphe graminis f.* sp *tritici* | wlm0.pk0009.g9 |
|  |  | wlm0.pk0018.f3 |
| wlm1 | Wheat Seedling 1 Hour After Inoculation With *Erysiphe graminis f.* sp *tritici* | wlm1.pk0008.c11 |
|  |  | wlm1.pk0015.c4 |
| wlm24 | Wheat Seedling 24 Hours After Inoculation With *Erysiphe graminis f.* sp *tritici* | wlm24.pk0031.c1 |
| wlm4 | Wheat Seedling 4 Hours After Inoculation With *Erysiphe graminis f.* sp *tritici* | wlm4.pk0003.g1 |
|  |  | wlm4.pk0009.a8 |
| wlm96 | Wheat Seedling 96 Hours After Inoculation With *Erysiphe graminis f.* sp *tritici* | wlm96.pk0007.a5 |
|  |  | wlm96.pk0020.d2 |
|  |  | wlm96.pk030.m18 |
|  |  | wlm96.pk031.g10 |
|  |  | wlm96.pk054.b17 |
|  |  | wlm96.pk061.l12 |
| wlmk1 | Wheat Seedling 1 Hour After Inoculation With *Erysiphe graminis f.* sp *tritici* and Treatment With Herbicide[11] | wlmk1.pk0010.e2 |
| wlmk8 | Wheat Seedling 8 Hours After Inoculation With *Erysiphe graminis f.* sp *tritici* and Treatment With Herbicide[11] | wlmk8.pk0019.f6 |
| wr1 | Wheat Root From 7 Day Old Seedling Light Grown | wr1.pk0055.a12 |
|  |  | wr1.pk0068.h1 |
|  |  | wr1.pk0096.h7 |
|  |  | wr1.pk164.e12 |
|  |  | wr1.pk167.c6 |
|  |  | wr1.pk178.b2 |

TABLE 4-continued cDNA Libraries from Barley, African Daisy, *Eucalyptus tereticornis*,
Para Rubber, Cattail, Jerusalem Artichoke, Florida Bitterbush,
Grape, *Vernonia*, Corn[1], Rice, Soybean, and Wheat

| Library | Tissue | Clone |
|---------|--------|-------|
| wre1n | Wheat Root From 7 Day Old Etiolated Seedling[2] | wre1n.pk0059.b9<br>wre1n.pk0104.f4<br>wre1n.pk183.h2 |
| wyr1c | Wheat Yellow Rust Infested Tissue | wyr1c.pk003.b6 |

[1]Corn developmental stages are explained in the publication "How a corn plant develops" from the Iowa State University Coop. Ext. Service Special Report No. 48 reprinted June 1993.
[2]These libraries were normalized essentially as described in U.S. Pat. No. 5,482,845, incorporated herein by reference.
[3]Application of 2-[(2,4-dihydro-2,6,9-trimethyl[1]benzothiopyrano[4,3-c]pyrazol-8-yl)carbonyl]-1,3-cyclohexanedione S,S-dioxide (synthesis and methods of using this compound are described in WO 97/19087, incorporated herein by reference)
[4]Chemicals used included suramin, MAS7, dipyridamole, zaprinast, 8-bromo-cGMP, trequinsin HCl, compound 48/80, all of which are commercially available from Calbiochem-Novabiochem Corp. (1-800-628-8470)
[5]Chemicals used included okadaic acid, cyclosporin A, calyculin A, cypermethrin, all of which are commercially available from Calbiochem-Novabiochem Corp. (1-800-628-8470)
[6]Chemicals used included chloramphenicol, cyclohexamide, aurintricarboxylic acid, all of which are commercially available from Calbiochem-Novabiochem Corp. (1-800-628-8470)
[7]Chemicals used included diphenylene iodonium Cl, $H_2O_2$, paraquat, glutathione, N-acetyl-L-cysteine, aminotriazole, all of which are commercially available from Calbiochem-Novabiochem Corp. (1-800-628-8470)
[8]Chemicals used included sorbitol, egosterol, taxifolin, methotrexate, D-mannose, D-galactose, alpha-amino adipic acid, ancymidol, all of which are commercially available from Calbiochem-Novabiochem Corp. (1-800-628-8470)
[9]Chemicals used included valinomycin, bafilomycin A1, oligomycin, ionomycin, all of which are commercially available from Calbiochem-Novabiochem Corp. (1-800-628-8470)
[10]Application of N-(3,6-dihydro-2H-pyran-4-yl)-4-(3,5-dimethyl-4-isoxazolyl)-4,5-dihydro-N-(1-methylethyl)-5-oxo-1H-tetrazole-1-carboxamide (synthesis and methods of using this compound are described in WO98/35961, incorporated herein by reference)
[11]Application of 6-iodo-2-propoxy-3-propyl-4(3H)-quinazolinone (synthesis and methods of using this compound are described in U.S. ser. no. 08/545,827, incorporated herein by reference)

Soybean clone sne1x.pk004.j22 was derived from library sne1x, which is a soybean (variety Tokyo) nebulized genomic library.

cDNA libraries may be prepared by any one of many methods available. For example, the cDNAs may be introduced into plasmid vectors by first preparing the cDNA libraries in Uni-ZAP™ XR vectors according to the manufacturer's protocol (Stratagene Cloning Systems, La Jolla, Calif.). The Uni-ZAP™ XR libraries are converted into plasmid libraries according to the protocol provided by Stratagene. Upon conversion, cDNA inserts will be contained in the plasmid vector pBluescript. In addition, the cDNAs may be introduced directly into precut Bluescript II SK(+) vectors (Stratagene) using T4 DNA ligase (New England Biolabs), followed by transfection into DH10B cells according to the manufacturer's protocol (GIBCO BRL Products). Once the cDNA inserts are in plasmid vectors, plasmid DNAs are prepared from randomly picked bacterial colonies containing recombinant pBluescript plasmids, or the insert cDNA sequences are amplified via polymerase chain reaction using primers specific for vector sequences flanking the inserted cDNA sequences. Amplified insert DNAs or plasmid DNAs are sequenced in dye-primer sequencing reactions to generate partial cDNA sequences (expressed sequence tags or "ESTs"; see Adams et al., (1991) *Science* 252:1651-1656). The resulting ESTs are analyzed using a Perkin Elmer Model 377 fluorescent sequencer.

Definitions

Units, prefixes, and symbols may be denoted in their SI accepted form. Unless otherwise indicated, nucleic acids are written left to right in 5' to 3' orientation; amino acid sequences are written left to right in amino to carboxy orientation, respectively. Numeric ranges recited within the specification are inclusive of the numbers defining the range and include each integer within the defined range. Amino acids may be referred to herein by either their commonly known three letter symbols or by the one-letter symbols recommended by the IUPAC-IUBMB Nomenclature Commission. Nucleotides, likewise, may be referred to by their commonly accepted single-letter codes. Unless otherwise provided for, software, electrical, and electronics terms as used herein are as defined in The New IEEE Standard Dictionary of Electrical and Electronics Terms (5th edition, 1993). The terms defined below are more fully defined by reference to the specification as a whole. Section headings provided throughout the specification are not limitations to the various objects and embodiments of the present invention.

By "amplified" is meant the construction of multiple copies of a nucleic acid sequence or multiple copies complementary to the nucleic acid sequence using at least one of the nucleic acid sequences as a template. Amplification systems include the polymerase chain reaction (PCR) system, ligase chain reaction (LCR) system, nucleic acid sequence based amplification (NASBA, Cangene, Mississauga, Ontario), Q-Beta Replicase systems, transcription-based amplification system (TAS), and strand displacement amplification (SDA). See, e.g., *Diagnostic Molecular Microbiology: Principles and Applications*, D. H. Persing et al., Ed., American Society for Microbiology, Washington, D.C. (1993). The product of amplification is termed an amplicon.

As used herein, "antisense orientation" includes reference to a duplex polynucleotide sequence that is operably linked to a promoter in an orientation where the antisense strand is transcribed. The antisense strand is sufficiently complementary to an endogenous transcription product such that translation of the endogenous transcription product is often inhibited.

By "encoding" or "encoded", with respect to a specified nucleic acid, is meant comprising the information for translation into the specified protein. A nucleic acid encoding a protein may comprise intervening sequences (e.g., introns) within translated regions of the nucleic acid, or may lack such intervening sequences (e.g., as in cDNA). The information by which a protein is encoded is specified by the use of codons. Typically, the amino acid sequence is encoded by the nucleic acid using the "universal" genetic code. However, variants of the universal code, such as are present in some plant, animal, and fungal mitochondria, the bacterium *Mycoplasma capricolum*, or the ciliate Macronucleus, may be used when the nucleic acid is expressed therein.

When the nucleic acid is prepared or altered synthetically, advantage can be taken of known codon preferences of the intended host where the nucleic acid is to be expressed. For example, although nucleic acid sequences of the present invention may be expressed in both monocotyledonous and dicotyledonous plant species, sequences can be modified to account for the specific codon preferences and GC content preferences of monocotyledons or dicotyledons as these preferences have been shown to differ (Murray et al., *Nucl. Acids Res.* 17:477-498 (1989)). Thus, the maize preferred codon for a particular amino acid may be derived from known gene sequences from maize. Maize codon usage for 28 genes from maize plants is listed in Table 4 of Murray et al., supra.

As used herein "full-length sequence" in reference to a specified polynucleotide or its encoded protein means having the entire amino acid sequence of, a native (non-synthetic), endogenous, biologically (e.g., structurally or catalytically) active form of the specified protein. Methods to determine whether a sequence is full-length are well known in the art including such exemplary techniques as northern or western blots, primer extension, SI protection, and ribonuclease protection. See, e.g., *Plant Molecular Biology: A Laboratory Manual*, Clark, Ed., Springer-Verlag, Berlin (1997). Comparison to known full-length homologous (orthologous and/or paralogous) sequences can also be used to identify full-length sequences of the present invention. Additionally, consensus sequences typically present at the 5' and 3' untranslated regions of mRNA aid in the identification of a polynucleotide as full-length. For example, the consensus sequence ANNNN$\underline{A}$UGG, where the underlined codon represents the N-terminal methionine, aids in determining whether the polynucleotide has a complete 5' end. Consensus sequences at the 3' end, such as polyadenylation sequences, aid in determining whether the polynucleotide has a complete 3' end.

As used herein, "heterologous" in reference to a nucleic acid is a nucleic acid that originates from a foreign species, or, if from the same species, is substantially modified from its native form in composition and/or genomic locus by human intervention. For example, a promoter operably linked to a heterologous structural gene is from a species different from that from which the structural gene was derived, or, if from the same species, one or both are substantially modified from their original form. A heterologous protein may originate from a foreign species or, if from the same species, is substantially modified from its original form by human intervention.

By "host cell" is meant a cell which contains a vector and supports the replication and/or expression of the vector. Host cells may be prokaryotic cells such as *E. coli*, or eukaryotic cells such as yeast, insect, amphibian, or mammalian cells. Preferably, host cells are monocotyledonous or dicotyledonous plant cells. A particularly preferred monocotyledonous host cell is a maize host cell.

The term "introduced" includes reference to the incorporation of a nucleic acid into a eukaryotic or prokaryotic cell where the nucleic acid may be incorporated into the genome of the cell (e.g., chromosome, plasmid, plastid or mitochondrial DNA), converted into an autonomous replicon, or transiently expressed (e.g., transfected mRNA). The term includes such nucleic acid introduction means as "transfection", "transformation" and "transduction".

The term "isolated" refers to material, such as a nucleic acid or a protein, which is substantially free from components that normally accompany or interact with it as found in its naturally occurring environment. The isolated material optionally comprises material not found with the material in its natural environment, or if the material is in its natural environment, the material has been synthetically (non-naturally) altered by human intervention to a composition and/or placed at a location in the cell (e.g., genome or subcellular organelle) not native to a material found in that environment. The alteration to yield the synthetic material can be performed on the material within or removed from its natural state. For example, a naturally occurring nucleic acid becomes an isolated nucleic acid if it is altered, or if it is transcribed from DNA which has been altered, by means of human intervention performed within the cell from which it originates. See, e.g., Compounds and Methods for Site Directed Mutagenesis in Eukaryotic Cells, Kmiec, U.S. Pat. No. 5,565,350; In Vivo Homologous Sequence Targeting in Eukaryotic Cells; Zarling et al., PCT/US93/03868. Likewise, a naturally occurring nucleic acid (e.g., a promoter) becomes isolated if it is introduced by non-naturally occurring means to a locus of the genome not native to that nucleic acid. Nucleic acids which are "isolated" as defined herein, are also referred to as "heterologous" nucleic acids.

As used herein, "nucleic acid" includes reference to a deoxyribonucleotide or ribonucleotide polymer, or chimeras thereof, in either single- or double-stranded form, and unless otherwise limited, encompasses known analogues having the essential nature of natural nucleotides in that they hybridize to single-stranded nucleic acids in a manner similar to naturally occurring nucleotides (e.g., peptide nucleic acids).

By "nucleic acid library" is meant a collection of isolated DNA or RNA molecules which comprise and substantially represent the entire transcribed fraction of a genome of a specified organism, tissue, or of a cell type from that organism. Construction of exemplary nucleic acid libraries, such as genomic and cDNA libraries, is taught in standard molecular biology references such as Berger and Kimmel, *Guide to Molecular Cloning Techniques, Methods in Enzymology*, Vol. 152, Academic Press, Inc., San Diego, Calif. (Berger); Sambrook et al., *Molecular Cloning—A Laboratory Manual*, 2nd ed., Vol. 1-3 (1989); and *Current Protocols in Molecular Biology*, F. M. Ausubel et al., Eds., Current Protocols, a joint venture between Greene Publishing Associates, Inc. and John Wiley & Sons, Inc. (1994).

As used herein "operably linked" includes reference to a functional linkage between a promoter and a second sequence, wherein the promoter sequence initiates and mediates transcription of the DNA sequence corresponding to the second sequence. Generally, operably linked means that the nucleic acid sequences being linked are contiguous and, where necessary to join two protein coding regions, contiguous and in the same reading frame.

As used herein, the term "plant" includes reference to whole plants, plant organs (e.g., leaves, stems, roots, etc.), seeds and plant cells and progeny of same. Plant cell, as used herein includes, without limitation, seeds, suspension cultures, embryos, meristematic regions, callus tissue, leaves, roots, shoots, gametophytes, sporophytes, pollen, and microspores. The class of plants which can be used in the methods of the invention include both monocotyledonous and dicotyledonous plants. Particularly preferred plants include corn (*Zea mays*), rice (*Oryza sativa*), soybean (*Glycine max*), and wheat (*Triticum aestivum*).

As used herein, "polynucleotide" includes reference to a deoxyribopolynucleotide, ribopolynucleotide, or chimeras or analogs thereof that have the essential nature of a natural deoxy- or ribo-nucleotide in that they hybridize, under stringent hybridization conditions, to substantially the same nucleotide sequence as naturally occurring nucleotides and/or allow translation into the same amino acid(s) as the naturally occurring nucleotide(s). A polynucleotide can be full-length or a subsequence of a native or heterologous structural or regulatory gene. Unless otherwise indicated, the term includes reference to the specified sequence as well as the complementary sequence thereof. Thus, DNAs or RNAs with backbones modified for stability or for other reasons are "polynucleotides" as that term is intended herein. Moreover, DNAs or RNAs comprising unusual bases, such as inosine, or modified bases, such as tritylated bases, to name just two examples, are polynucleotides as the term is used herein. It will be appreciated that a great variety of modifications have been made to DNA and RNA that serve many useful purposes known to those of skill in the art. The term polynucleotide as it is employed herein embraces such chemically, enzymatically or metabolically modified forms of polynucleotides, as well as the chemical forms of DNA and RNA characteristic of viruses and cells, including among other things, simple and complex cells.

The terms "polypeptide", "peptide" and "protein" are used interchangeably herein to refer to a polymer of amino acid residues. The terms apply to amino acid polymers in which one or more amino acid residue is an artificial chemical analogue of a corresponding naturally occurring amino acid, as well as to naturally occurring amino acid polymers. The essential nature of such analogues of naturally occurring amino acids is that, when incorporated into a protein, that protein is specifically reactive to antibodies elicited to the same protein but consisting entirely of naturally occurring amino acids. The terms "polypeptide", "peptide" and "protein" are also inclusive of modifications including, but not limited to, glycosylation, lipid attachment, sulfation, gamma-carboxylation of glutamic acid residues, hydroxylation and ADP-ribosylation. Further, this invention contemplates the use of both the methionine-containing and the methionine-less amino terminal variants of the protein of the invention.

As used herein "promoter" includes reference to a region of DNA upstream from the start of transcription and involved in recognition and binding of RNA polymerase and other proteins to initiate transcription. A "plant promoter" is a promoter capable of initiating transcription in plant cells whether or not its origin is a plant cell. Exemplary plant promoters include, but are not limited to, those that are obtained from plants, plant viruses, and bacteria which comprise genes expressed in plant cells such *Agrobacterium* or *Rhizobium*. Examples of promoters under developmental control include promoters that preferentially initiate transcription in certain tissues, such as leaves, roots, or seeds. Such promoters are referred to as "tissue preferred". Promoters which initiate transcription only in certain tissue are referred to as "tissue specific". A "cell type" specific promoter primarily drives expression in certain cell types in one or more organs, for example, vascular cells in roots or leaves. An "inducible" or "repressible" promoter is a promoter which is under environmental control. Examples of environmental conditions that may effect transcription by inducible promoters include anaerobic conditions or the presence of light. Tissue specific, tissue preferred, cell type specific, and inducible promoters constitute the class of "non-constitutive" promoters. A "constitutive" promoter is a promoter which is active under most environmental conditions.

As used herein "recombinant" includes reference to a cell or vector, that has been modified by the introduction of a heterologous nucleic acid or that the cell is derived from a cell so modified. Thus, for example, recombinant cells express genes that are not found in identical form within the native (non-recombinant) form of the cell or express native genes that are otherwise abnormally expressed, under-expressed or not expressed at all as a result of human intervention. The term "recombinant" as used herein does not encompass the alteration of the cell or vector by naturally occurring events (e.g., spontaneous mutation, natural transformation/transduction/transposition) such as those occurring without human intervention.

As used herein, a "recombinant expression cassette" is a nucleic acid construct, generated recombinantly or synthetically, with a series of specified nucleic acid elements which permit transcription of a particular nucleic acid in a host cell. The recombinant expression cassette can be incorporated into a plasmid, chromosome, mitochondrial DNA, plastid DNA, virus, or nucleic acid fragment. Typically, the recombinant expression cassette portion of an expression vector includes, among other sequences, a nucleic acid to be transcribed, and a promoter.

The term "residue" or "amino acid residue" or "amino acid" are used interchangeably herein to refer to an amino acid that is incorporated into a protein, polypeptide, or peptide (collectively "protein"). The amino acid may be a naturally occurring amino acid and, unless otherwise limited, may encompass non-natural analogs of natural amino acids that can function in a similar manner as naturally occurring amino acids.

The term "selectively hybridizes" includes reference to hybridization, under stringent hybridization conditions, of a nucleic acid sequence to a specified nucleic acid target sequence to a detectably greater degree (e.g., at least 2-fold over background) than its hybridization to non-target nucleic acid sequences and to the substantial exclusion of non-target nucleic acids. Selectively hybridizing sequences typically have about at least 80% sequence identity, preferably 90% sequence identity, and most preferably 100% sequence identity (i.e., complementary) with each other.

The term "stringent conditions" or "stringent hybridization conditions" includes reference to conditions under which a probe will selectively hybridize to its target sequence, to a detectably greater degree than to other sequences (e.g., at least 2-fold over background). Stringent conditions are sequence-dependent and will be different in different circumstances. By controlling the stringency of the hybridization and/or washing conditions, target sequences can be identified which are 100% complementary to the probe (homologous probing). Alternatively, stringency conditions can be adjusted to allow some mismatching in sequences so that lower degrees of similarity are detected (heterologous probing). Generally, a probe is less than about 1000 nucleotides in length, optionally less than 500 nucleotides in length.

Typically, stringent conditions will be those in which the salt concentration is less than about 1.5 M Na ion, typically about 0.01 to 1.0 M Na ion concentration (or other salts) at pH 7.0 to 8.3 and the temperature is at least about 30° C. for short probes (e.g., 10 to 50 nucleotides) and at least about 60° C. for long probes (e.g., greater than 50 nucleotides). Stringent conditions may also be achieved with the addition of destabilizing agents such as formamide. Exemplary low stringency conditions include hybridization with a buffer solution of 30 to 35% formamide, 1 M NaCl, 1% SDS (sodium dodecyl sulphate) at 37° C., and a wash in 1× to 2×SSC (20×SSC=3.0 M NaCl/0.3 M trisodium citrate) at 50 to 55° C. Exemplary moderate stringency conditions include hybridization in 40 to 45% formamide, 1 M NaCl, 1% SDS at 37° C., and a wash in 0.5× to 1×SSC at 55 to 60° C. Exemplary high stringency conditions include hybridization in 50% formamide, 1 M NaCl, 1% SDS at 37° C., and a wash in 0.1×SSC at 60 to 65° C.

Specificity is typically the function of post-hybridization washes, the critical factors being the ionic strength and temperature of the final wash solution. For DNA-DNA hybrids, the $T_m$ can be approximated from the equation of Meinkoth and Wahl, *Anal. Biochem.*, 138:267-284 (1984): $T_m$=81.5° C.+16.6 (log M)+0.41 (% GC)-0.61 (% form)-500/L; where M is the molarity of monovalent cations, % GC is the percentage of guanosine and cytosine nucleotides in the DNA, % form is the percentage of formamide in the hybridization solution, and L is the length of the hybrid in base pairs. The $T_m$ is the temperature (under defined ionic strength and pH) at which 50% of a complementary target sequence hybridizes to a perfectly matched probe. $T_m$ is reduced by about 1° C. for each 1% of mismatching; thus, $T_m$, hybridization and/or wash conditions can be adjusted to hybridize to sequences of the desired identity. For example, if sequences with >90% identity are sought, the $T_m$ can be decreased 10° C. Generally, stringent conditions are selected to be about 5° C. lower than the thermal melting point ($T_m$) for the specific sequence and its complement at a defined ionic strength and pH. However, severely stringent conditions can utilize a hybridization and/or wash at 1, 2, 3, or 4° C. lower than the thermal melting point ($T_m$); moderately stringent conditions can utilize a hybridization and/or wash at 6, 7, 8, 9, or 10° C. lower than the thermal melting point ($T_m$); low stringency conditions can utilize a hybridization and/or wash at 11, 12, 13, 14, 15, or 20° C. lower than the thermal melting point ($T_m$). Using the equation, hybridization and wash compositions, and desired $T_m$, those of ordinary skill will understand that variations in the stringency of hybridization and/or wash solutions are inherently described. If the desired degree of mismatching results in a $T_m$ of less than 45° C. (aqueous solution) or 32° C. (formamide solution) it is preferred to increase the SSC concentration so that a higher temperature can be used. Hybridization and/or wash conditions can be applied for at least 10, 30, 60, 90, 120, or 240 minutes. An extensive guide to the hybridization of nucleic acids is found in Tijssen, *Laboratory Techniques in Biochemistry and Molecular Biology—Hybridization with Nucleic Acid Probes*, Part I, Chapter 2 "Overview of principles of hybridization and the strategy of nucleic acid probe assays", Elsevier, New York (1993); and *Current Protocols in Molecular Biology*, Chapter 2, Ausubel et al., Eds., Greene Publishing and Wiley-Interscience, New York (1995).

As used herein, "transgenic plant" includes reference to a plant which comprises within its genome a heterologous polynucleotide. Generally, the heterologous polynucleotide is stably integrated within the genome such that the polynucleotide is passed on to successive generations. The heterologous polynucleotide may be integrated into the genome alone or as part of a recombinant expression cassette. "Transgenic" is used herein to include any cell, cell line, callus, tissue, plant part or plant, the genotype of which has been altered by the presence of heterologous nucleic acid including those transgenics initially so altered as well as those created by sexual crosses or asexual propagation from the initial transgenic. The term "transgenic" as used herein does not encompass the alteration of the genome (chromosomal or extra-chromosomal) by conventional plant breeding methods or by naturally occurring events such as random cross-fertilization, non-recombinant viral infection, non-recombinant bacterial transformation, non-recombinant transposition, or spontaneous mutation.

As used herein, "vector" includes reference to a nucleic acid used in introduction of a polynucleotide of the present invention into a host cell. Vectors are often replicons. Expression vectors permit transcription of a nucleic acid inserted therein.

The following terms are used to describe the sequence relationships between a polynucleotide/polypeptide of the present invention with a reference polynucleotide/polypeptide: (a) "reference sequence", (b) "comparison window", (c) "sequence identity", and (d) "percentage of sequence identity".

(a) As used herein, "reference sequence" is a defined sequence used as a basis for sequence comparison with a polynucleotide/polypeptide of the present invention. A reference sequence may be a subset or the entirety of a specified sequence; for example, as a segment of a full-length cDNA or gene sequence, or the complete cDNA or gene sequence.

(b) As used herein, "comparison window" includes reference to a contiguous and specified segment of a polynucleotide/polypeptide sequence, wherein the polynucleotide/polypeptide sequence may be compared to a reference sequence and wherein the portion of the polynucleotide/polypeptide sequence in the comparison window may comprise additions or deletions (i.e., gaps) compared to the reference sequence (which does not comprise additions or deletions) for optimal alignment of the two sequences. Generally, the comparison window is at least 20 contiguous nucleotides/amino acids residues in length, and optionally can be 30, 40, 50, 100, or longer. Those of skill in the art understand that to avoid a high similarity to a reference sequence due to inclusion of gaps in the polynucleotide/polypeptide sequence, a gap penalty is typically introduced and is subtracted from the number of matches.

Methods of alignment of sequences for comparison are well-known in the art. Optimal alignment of sequences for comparison may be conducted by the local homology algorithm of Smith and Waterman, *Adv. Appl. Math.* 2:482 (1981); by the homology alignment algorithm of Needleman and Wunsch, *J. Mol. Biol.* 48:443 (1970); by the search for similarity method of Pearson and Lipman, *Proc. Natl. Acad. Sci.* 85:2444 (1988); by computerized implementations of these algorithms, including, but not limited to: CLUSTAL in the PC/Gene program by Intelligenetics, Mountain View, Calif.; GAP, BESTFIT, BLAST, FASTA, and TFASTA in the Wisconsin Genetics Software Package, Genetics Computer Group (GCG), 575 Science Dr., Madison, Wis., USA; the CLUSTAL program is well described by Higgins and Sharp, *Gene* 73:237-244 (1988); Higgins and Sharp, *CABIOS* 5:151-153 (1989); Corpet et al., *Nucleic Acids Research* 16:10881-90 (1988); Huang et al., *Computer Applications in the Biosciences* 8:155-65 (1992), and Pearson et al., *Methods in Molecular Biology* 24:307-331 (1994).

The BLAST family of programs which can be used for database similarity searches includes: BLASTN for nucleotide query sequences against nucleotide database sequences; BLASTX for nucleotide query sequences against protein database sequences; BLASTP for protein query sequences against protein database sequences; TBLASTN for protein query sequences against nucleotide database sequences; and TBLASTX for nucleotide query sequences against nucleotide database sequences. See Current Protocols in Molecular Biology, Chapter 19, Ausubel et al., Eds., Greene Publishing and Wiley-Interscience, New York (1995); Altschul et al., *J. Mol. Biol.*, 215:403-410 (1990); and, Altschul et al., *Nucleic Acids Res.* 25:3389-3402 (1997).

Software for performing BLAST analyses is publicly available, e.g., through the National Center for Biotechnology Information. This algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold. These initial neighborhood word hits act as seeds for initiating searches to find longer HSPs containing them. The word hits are then extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) of 10, a cutoff of 100, M=5, N=−4, and a comparison of both strands. For amino acid sequences, the BLASTP program uses as defaults a wordlength (W) of 3, an expectation (E) of 10, and the BLOSUM62 scoring matrix (see Henikoff & Henikoff (1989) *Proc. Natl. Acad. Sci. USA* 89:10915).

In addition to calculating percent sequence identity, the BLAST algorithm also performs a statistical analysis of the similarity between two sequences (see e.g., Karlin & Altschul, *Proc. Nat'l Acad. Sci. USA* 90:5873-5877 (1993)). One measure of similarity provided by the BLAST algorithm is the smallest sum probability (P(N)), which provides an indication of the probability by which a match between two nucleotide or amino acid sequences would occur by chance.

BLAST searches assume that proteins can be modeled as random sequences. However, many real proteins comprise regions of nonrandom sequences which may be homopolymeric tracts, short-period repeats, or regions enriched in one or more amino acids. Such low-complexity regions may be aligned between unrelated proteins even though other regions of the protein are entirely dissimilar. A number of low-complexity filter programs can be employed to reduce such low-complexity alignments. For example, the SEG (Wooten and Federhen, *Comput. Chem.*, 17:149-163 (1993)) and XNU (Claverie and States, *Comput. Chem.*, 17:191-201 (1993)) low-complexity filters can be employed alone or in combination.

Unless otherwise stated, nucleotide and protein identity/similarity values provided herein are calculated using GAP (GCG Version 10) under default values.

GAP (Global Alignment Program) can also be used to compare a polynucleotide or polypeptide of the present invention with a reference sequence. GAP uses the algorithm of Needleman and Wunsch (*J. Mol. Biol.* 48:443-453, 1970) to find the alignment of two complete sequences that maximizes the number of matches and minimizes the number of gaps. GAP considers all possible alignments and gap positions and creates the alignment with the largest number of matched bases and the fewest gaps. It allows for the provision of a gap creation penalty and a gap extension penalty in units of matched bases. GAP must make a profit of gap creation penalty number of matches for each gap it inserts. If a gap extension penalty greater than zero is chosen, GAP must, in addition, make a profit for each gap inserted of the length of the gap times the gap extension penalty. Default gap creation penalty values and gap extension penalty values in Version 10 of the Wisconsin Genetics Software Package for protein sequences are 8 and 2, respectively. For nucleotide sequences the default gap creation penalty is 50 while the default gap extension penalty is 3. The gap creation and gap extension penalties can be expressed as an integer selected from the group of integers consisting of from 0 to 100. Thus, for example, the gap creation and gap extension penalties can each independently be: 0, 1, 2, 3, 4, 5, 6, 7, 8, 9, 10, 15, 20, 30, 40, 50, 60 or greater.

GAP presents one member of the family of best alignments. There may be many members of this family, but no other member has a better quality. GAP displays four figures of merit for alignments: Quality, Ratio, Identity, and Similarity. The Quality is the metric maximized in order to align the sequences. Ratio is the quality divided by the number of bases in the shorter segment. Percent Identity is the percent of the symbols that actually match. Percent Similarity is the percent of the symbols that are similar. Symbols that are across from gaps are ignored. A similarity is scored when the scoring matrix value for a pair of symbols is greater than or equal to 0.50, the similarity threshold. The scoring matrix used in Version 10 of the Wisconsin Genetics Software Package is BLOSUM62 (see Henikoff & Henikoff (1989) *Proc. Natl. Acad. Sci. USA* 89: 10915).

Multiple alignment of the sequences can be performed using the CLUSTAL method of alignment (Higgins and Sharp (1989) *CABIOS.* 5:151-153) with the default parameters (GAP PENALTY=10, GAP LENGTH PENALTY=10). Default parameters for pairwise alignments using the CLUSTAL method are KTUPLE 1, GAP PENALTY=3, WINDOW=5 and DIAGONALS SAVED=5.

(c) As used herein, "sequence identity" or "identity" in the context of two nucleic acid or polypeptide sequences includes reference to the residues in the two sequences which are the same when aligned for maximum correspondence over a specified comparison window. When percentage of sequence identity is used in reference to proteins it is recognized that residue positions which are not identical often differ by conservative amino acid substitutions, where amino acid residues are substituted for other amino acid residues with similar chemical properties (e.g., charge or hydrophobicity) and therefore do not change the functional properties of the molecule. Where sequences differ in conservative substitutions, the percent sequence identity may be adjusted upwards to correct for the conservative nature of the substitution. Sequences which differ by such conservative substitutions are said to have "sequence similarity" or "similarity". Means for making this adjustment are well-known to those of skill in the art. Typically this involves scoring a conservative substitution as a partial rather than a full mismatch, thereby increasing the percentage sequence identity. Thus, for example, where an identical amino acid is given a score of 1 and a non-conservative substitution is given a score of zero, a conservative substitution is given a score between zero and 1. The scoring of conservative substitutions is calculated, e.g., according to the algorithm of Meyers and Miller, *Computer Applic. Biol. Sci.*, 4:11-17 (1988) e.g., as implemented in the program PC/GENE (Intelligenetics, Mountain View, Calif., USA).

(d) As used herein, "percentage of sequence identity" means the value determined by comparing two optimally aligned sequences over a comparison window, wherein the portion of the polynucleotide sequence in the comparison window may comprise additions or deletions (i.e., gaps) as compared to the reference sequence (which does not comprise additions or deletions) for optimal alignment of the two sequences. The percentage is calculated by determining the number of positions at which the identical nucleic acid base or amino acid residue occurs in both sequences to yield the number of matched positions, dividing the number of matched positions by the total number of positions in the window of comparison and multiplying the result by 100 to yield the percentage of sequence identity.

Utilities

The present invention provides, among other things, compositions and methods for modulating (i.e., increasing or decreasing) the level of polynucleotides and polypeptides of the present invention in plants. In particular, the polynucleotides and polypeptides of the present invention can be expressed temporally or spatially, e.g., at developmental stages, in tissues, and/or in quantities, which are uncharacteristic of non-recombinantly engineered plants.

The present invention also provides isolated nucleic acids comprising polynucleotides of sufficient length and complementarity to a polynucleotide of the present invention to use as probes or amplification primers in the detection, quantitation, or isolation of gene transcripts. For example, isolated nucleic acids of the present invention can be used as probes in detecting deficiencies in the level of mRNA in screenings for desired transgenic plants, for detecting mutations in the gene (e.g., substitutions, deletions, or additions), for monitoring upregulation of expression or changes in enzyme activity in screening assays of compounds, for detection of any number of allelic variants (polymorphisms), orthologs, or paralogs of the gene, or for site directed mutagenesis in eukaryotic cells (see, e.g., U.S. Pat. No. 5,565,350). The isolated nucleic acids of the present invention can also be used for recombinant expression of their encoded polypeptides, or for use as immunogens in the preparation and/or screening of antibodies. The isolated nucleic acids of the present invention can also be employed for use in sense or antisense suppression of one or more genes of the present invention in a host cell, tissue, or plant. Attachment of chemical agents which bind, intercalate, cleave and/or crosslink to the isolated nucleic acids of the present invention can also be used to modulate transcription or translation.

The present invention also provides isolated proteins comprising a polypeptide of the present invention (e.g., preproenzyme, proenzyme, or enzymes). The present invention also provides proteins comprising at least one epitope from a polypeptide of the present invention. The proteins of the present invention can be employed in assays for enzyme agonists or antagonists of enzyme function, or for use as immunogens or antigens to obtain antibodies specifically immunoreactive with a protein of the present invention. Such antibodies can be used in assays for expression levels, for identifying and/or isolating nucleic acids of the present invention from expression libraries, for identification of homologous polypeptides from other species, or for purification of polypeptides of the present invention.

The isolated nucleic acids and polypeptides of the present invention can be used over a broad range of plant types, particularly monocots such as the species of the family Gramineae including *Hordeum, Secale, Oryza, Triticum, Sorghum* (e.g., *S. bicolor*) and *Zea* (e.g., *Z. mays*), and dicots such as Glycine.

The isolated nucleic acid and proteins of the present invention can also be used in species from the genera: *Cucurbita, Rosa, Vitis, Juglans, Fragaria, Lotus, Medicago, Onobrychis, Trifolium, Trigonella, Vigna, Citrus, Linum, Geranium, Manihot, Daucus, Arabidopsis, Brassica, Raphanus, Sinapis, Atropa, Capsicum, Datura, Hyoscyamus, Lycopersicon, Nicotiana, Solanum, Petunia, Digitalis, Majorana, Ciahorium, Helianthus, Lactuca, Bromus, Asparagus, Antirrhinum, Heterocallis, Nemesis, Pelargonium, Panieum, Pennisetum, Ranunculus, Senecio, Salpiglossis, Cucumis, Browallia, Pisum, Phaseolus, Lolium,* and *Avena.*

Nucleic Acids

The present invention provides, among other things, isolated nucleic acids of RNA, DNA, and analogs and/or chimeras thereof, comprising a polynucleotide of the present invention.

A polynucleotide of the present invention is inclusive of those in Table 1 and:

(a) an isolated polynucleotide encoding a polypeptide of the present invention such as those referenced in Table 1, including exemplary polynucleotides of the present invention;

(b) an isolated polynucleotide which is the product of amplification from a plant nucleic acid library using primer pairs which selectively hybridize under stringent conditions to loci within a polynucleotide of the present invention;

(c) an isolated polynucleotide which selectively hybridizes to a polynucleotide of (a) or (b);

(d) an isolated polynucleotide having a specified sequence identity with polynucleotides of (a), (b), or (c);

(e) an isolated polynucleotide encoding a protein having a specified number of contiguous amino acids from a prototype polypeptide, wherein the protein is specifically recognized by antisera elicited by presentation of the protein and wherein the protein does not detectably immunoreact to antisera which has been fully immunosorbed with the protein;

(f) complementary sequences of polynucleotides of (a), (b), (c), (d), or (e); and (g) an isolated polynucleotide comprising at least a specific number of contiguous nucleotides from a polynucleotide of (a), (b), (c), (d), (e), or (f);

(h) an isolated polynucleotide from a full-length enriched cDNA library having the physico-chemical property of selectively hybridizing to a polynucleotide of (a), (b), (c), (d), (e), (f), or (g);

(i) an isolated polynucleotide made by the process of: 1) providing a full-length enriched nucleic acid library, 2) selectively hybridizing the polynucleotide to a polynucleotide of (a), (b), (c), (d), (e), (f), (g), or (h), thereby isolating the polynucleotide from the nucleic acid library.

A. Polynucleotides Encoding a Polypeptide of the Present Invention

As indicated in (a), above, the present invention provides isolated nucleic acids comprising a polynucleotide of the present invention, wherein the polynucleotide encodes a polypeptide of the present invention. Every nucleic acid sequence herein that encodes a polypeptide also, by reference to the genetic code, describes every possible silent variation of the nucleic acid. One of ordinary skill will recognize that each codon in a nucleic acid (except AUG, which is ordinarily the only codon for methionine; and UGG, which is ordinarily the only codon for tryptophan) can be modified to yield a functionally identical molecule. Thus, each silent variation of a nucleic acid which encodes a polypeptide of the present invention is implicit in each described polypeptide sequence and is within the scope of the present invention. Accordingly, the present invention includes polynucleotides of the present invention and polynucleotides encoding a polypeptide of the present invention.

B. Polynucleotides Amplified from a Plant Nucleic Acid Library

As indicated in (b), above, the present invention provides an isolated nucleic acid comprising a polynucleotide of the present invention, wherein the polynucleotides are amplified, under nucleic acid amplification conditions, from a plant nucleic acid library. Nucleic acid amplification conditions for each of the variety of amplification methods are well known to those of ordinary skill in the art. The plant nucleic acid library can be constructed from a monocot such as a cereal crop. Exemplary cereals include corn, sorghum, alfalfa, canola, wheat, or rice. The plant nucleic acid library can also be constructed from a dicot such as soybean. *Zea mays* lines B73, PHRE1, A632, BMS-P2#10, W23, and Mo17 are known and publicly available. Other publicly known and available maize lines can be obtained from the Maize Genetics Cooperation (Urbana, Ill.). Wheat lines are available from the Wheat Genetics Resource Center (Manhattan, Kans.).

The nucleic acid library may be a cDNA library, a genomic library, or a library generally constructed from nuclear transcripts at any stage of intron processing. cDNA libraries can be normalized to increase the representation of relatively rare cDNAs. In optional embodiments, the cDNA library is constructed using an enriched full-length cDNA synthesis method. Examples of such methods include Oligo-Capping (Maruyama, K. and Sugano, S. *Gene* 138:171 174, 1994), Biotinylated CAP Trapper (Carninci, et al. *Genomics* 37:327-336, 1996), and CAP Retention Procedure (Edery, E., Chu, L. L. et al., *Molecular and Cellular Biology* 15:3363-3371, 1995). Rapidly growing tissues or rapidly dividing cells are preferred for use as an mRNA source for construction of a cDNA library. Growth stages of corn is described in "How a Corn Plant Develops," Special Report No. 48, Iowa State University of Science and Technology Cooperative Extension Service, Ames, Iowa, Reprinted February 1993.

A polynucleotide of this embodiment (or subsequences thereof) can be obtained, for example, by using amplification primers which are selectively hybridized and primer extended, under nucleic acid amplification conditions, to at least two sites within a polynucleotide of the present invention, or to two sites within the nucleic acid which flank and comprise a polynucleotide of the present invention, or to a site within a polynucleotide of the present invention and a site within the nucleic acid which comprises it. Methods for obtaining 5' and/or 3' ends of a vector insert are well known in the art. See e.g., RACE (Rapid Amplification of Complementary Ends) as described in Frohman, M. A., in PCR Protocols: A Guide to Methods and Applications, M. A. Innis, D. H. Gelfand, J. J. Sninsky, T. J. White, Eds. (Academic Press, Inc., San Diego), pp. 28-38 (1990)); see also, U.S. Pat. No. 5,470,722, and *Current Protocols in Molecular Biology*, Unit 15.6, Ausubel et al., Eds., Greene Publishing and Wiley-Interscience, New York (1995); Frohman and Martin, *Techniques* 1:165 (1989).

Optionally, the primers are complementary to a subsequence of the target nucleic acid which they amplify but may have a sequence identity ranging from about 85% to 99% relative to the polynucleotide sequence which they are designed to anneal to. As those skilled in the art will appreciate, the sites to which the primer pairs will selectively hybridize are chosen such that a single contiguous nucleic acid can be formed under the desired nucleic acid amplification conditions. The primer length in nucleotides is selected from the group of integers consisting of from at least 15 to 50. Thus, the primers can be at least 15, 18, 20, 25, 30, 40, or 50 nucleotides in length. Those of skill will recognize that a lengthened primer sequence can be employed to increase specificity of binding (i.e., annealing) to a target sequence. A non-annealing sequence at the 5' end of a primer (a "tail") can be added, for example, to introduce a cloning site at the terminal ends of the amplicon.

The amplification products can be translated using expression systems well known to those of skill in the art. The resulting translation products can be confirmed as polypeptides of the present invention by, for example, assaying for the appropriate catalytic activity (e.g., specific activity and/or substrate specificity), or verifying the presence of one or more epitopes which are specific to a polypeptide of the present invention. Methods for protein synthesis from PCR derived templates are known in the art and available commercially. See e.g., Amersham Life Sciences, Inc., Catalog '97, p. 354.

C. Polynucleotides Which Selectively Hybridize to a Polynucleotide of (A) or (B)

As indicated in (c), above, the present invention provides isolated nucleic acids comprising polynucleotides of the present invention, wherein the polynucleotides selectively hybridize, under selective hybridization conditions, to a polynucleotide of sections (A) or (B) as discussed above. Thus, the polynucleotides of this embodiment can be used for isolating, detecting, and/or quantifying nucleic acids comprising the polynucleotides of (A) or (B). For example, polynucleotides of the present invention can be used to identify, isolate, or amplify partial or full-length clones in a deposited library. In some embodiments, the polynucleotides are genomic or cDNA sequences isolated or otherwise complementary to a cDNA from a dicot or monocot nucleic acid library. Exemplary species of monocots and dicots include, but are not limited to: maize, canola, soybean, cotton, wheat, sorghum, sunflower, alfalfa, oats, sugar cane, millet, barley, and rice. The cDNA library comprises at least 50% to 95% full-length sequences (for example, at least 50%, 60%, 70%, 80%, 90%, or 95% full-length sequences). The cDNA libraries can be normalized to increase the representation of rare sequences. See e.g., U.S. Pat. No. 5, 482, 845. Low stringency hybridization conditions are typically, but not exclusively, employed with sequences having a reduced sequence identity relative to complementary sequences. Moderate and high stringency conditions can optionally be employed for sequences of greater identity. Low stringency conditions allow selective hybridization of sequences having about 70% to 80% sequence identity and can be employed to identify orthologous or paralogous sequences.

D. Polynucleotides Having a Specific Sequence Identity with the Polynucleotides of (A), (B) or (C)

As indicated in (d), above, the present invention provides isolated nucleic acids comprising polynucleotides of the present invention, wherein the polynucleotides have a specified identity at the nucleotide level to a polynucleotide as disclosed above in sections (A), (B), or (C), above. Identity can be calculated using, for example, the BLAST, CLUSTALW, or GAP algorithms under default conditions. The percentage of identity to a reference sequence is at least 60% and, rounded upwards to the nearest integer, can be expressed as an integer selected from the group of integers consisting of from 60 to 99. Thus, for example, the percentage of identity to a reference sequence can be at least 70%, 75%, 80%, 85%, 90%, or 95%.

Optionally, the polynucleotides of this embodiment will encode a polypeptide that will share an epitope with a polypeptide encoded by the polynucleotides of sections (A), (B), or (C). Thus, these polynucleotides encode a first polypeptide which elicits production of antisera comprising antibodies which are specifically reactive to a second polypeptide encoded by a polynucleotide of (A), (B), or (C). However, the first polypeptide does not bind to antisera raised against itself when the antisera has been fully immunosorbed with the first polypeptide. Hence, the polynucleotides of this embodiment can be used to generate antibodies for use in, for example, the screening of expression libraries for nucleic acids comprising polynucleotides of (A), (B), or (C), or for purification of, or in immunoassays for, polypeptides encoded by the polynucleotides of (A), (B), or (C). The polynucleotides of this embodiment comprise nucleic acid sequences which can be employed for selective hybridization to a polynucleotide encoding a polypeptide of the present invention.

Screening polypeptides for specific binding to antisera can be conveniently achieved using peptide display libraries. This method involves the screening of large collections of peptides for individual members having the desired function or structure. Antibody screening of peptide display libraries is well known in the art. The displayed peptide sequences can be from 3 to 5000 or more amino acids in length, frequently from 5-100 amino acids long, and often from about 8 to 15 amino acids long. In addition to direct chemical synthetic methods for generating peptide libraries, several recombinant DNA methods have been described. One type involves the display of a peptide sequence on the surface of a bacteriophage or cell. Each bacteriophage or cell contains the nucleotide sequence encoding the particular displayed peptide sequence. Such methods are described in PCT patent publication Nos. 91/17271, 91/18980, 91/19818, and 93/08278. Other systems for generating libraries of peptides have aspects of both in vitro chemical synthesis and recombinant methods. See, PCT Patent publication Nos. 92/05258, 92/14843, and 97/20078. See also, U.S. Pat. Nos. 5,658,754; and 5,643,768. Peptide display libraries, vectors, and screening kits are commercially available from such suppliers as Invitrogen (Carlsbad, Calif.).

E. Polynucleotides Encoding a Protein Having a Subsequence from a Prototype Polypeptide and Cross-Reactive to the Prototype Polypeptide As indicated in (e), above, the present invention provides isolated nucleic acids comprising polynucleotides of the present invention, wherein the polynucleotides encode a protein having a subsequence of contiguous amino acids from a prototype polypeptide of the present invention such as are provided in (a), above. The length of contiguous amino acids from the prototype polypeptide is selected from the group of integers consisting of from at least 10 to the number of amino acids within the prototype sequence. Thus, for example, the polynucleotide can encode a polypeptide having a subsequence having at least 10, 15, 20, 25, 30, 35, 40, 45, or 50 contiguous amino acids from the prototype polypeptide. Further, the number of such subsequences encoded by a polynucleotide of the instant embodiment can be any integer selected from the group consisting of from 1 to 20, such as 2, 3, 4, or 5. The subsequences can be separated by any integer of nucleotides from 1 to the number of nucleotides in the sequence such as at least 5, 10, 15, 25, 50, 100, or 200 nucleotides.

The proteins encoded by polynucleotides of this embodiment, when presented as an immunogen, elicit the production of polyclonal antibodies which specifically bind to a prototype polypeptide such as but not limited to, a polypeptide encoded by the polynucleotide of (a) or (b), above. Generally, however, a protein encoded by a polynucleotide of this embodiment does not bind to antisera raised against the prototype polypeptide when the antisera has been fully immunosorbed with the prototype polypeptide. Methods of making and assaying for antibody binding specificity/affinity are well known in the art. Exemplary immunoassay formats include ELISA, competitive immunoassays, radioimmunoassays, Western blots, indirect immunofluorescent assays and the like.

In a preferred assay method, fully immunosorbed and pooled antisera which is elicited to the prototype polypeptide can be used in a competitive binding assay to test the protein. The concentration of the prototype polypeptide required to inhibit 50% of the binding of the antisera to the prototype polypeptide is determined. If the amount of the protein required to inhibit binding is less than twice the amount of the prototype protein, then the protein is said to specifically bind to the antisera elicited to the immunogen. Accordingly, the proteins of the present invention embrace allelic variants, conservatively modified variants, and minor recombinant modifications to a prototype polypeptide.

A polynucleotide of the present invention optionally encodes a protein having a molecular weight as the non-glycosylated protein within 20% of the molecular weight of the full-length non-glycosylated polypeptides of the present invention. Molecular weight can be readily determined by SDS-PAGE under reducing conditions. Optionally, the molecular weight is within 15% of a full length polypeptide of the present invention, more preferably within 10% or 5%, and most preferably within 3%, 2%, or 1% of a full length polypeptide of the present invention.

Optionally, the polynucleotides of this embodiment will encode a protein having a specific enzymatic activity at least 50%, 60%, 80%, or 90% of a cellular extract comprising the native, endogenous full-length polypeptide of the present invention. Further, the proteins encoded by polynucleotides of this embodiment will optionally have a substantially similar affinity constant ($K_m$) and/or catalytic activity (i.e., the microscopic rate constant, $k_{cat}$) as the native endogenous, full-length protein. Those of skill in the art will recognize that $k_{cat}/K_m$ value determines the specificity for competing substrates and is often referred to as the specificity constant. Proteins of this embodiment can have a $k_{cat}/K_m$ value at least 10% of a full-length polypeptide of the present invention as determined using the endogenous substrate of that polypeptide. Optionally, the $k_{cat}/K_m$ value will be at least 20%, 30%, 40%, 50%, and most preferably at least 60%, 70%, 80%, 90%, or 95% the $k_{cat}/K_m$ value of the full-length polypeptide of the present invention. Determination of $k_{cat}$, $K_m$, and $k_{cat}/K_m$ can be determined by any number of means well known to those of skill in the art. For example, the initial rates (i.e., the first 5% or less of the reaction) can be determined using rapid mixing and sampling techniques (e.g., continuous-flow, stopped-flow, or rapid quenching techniques), flash photolysis, or relaxation methods (e.g., temperature jumps) in conjunction with such exemplary methods of measuring as spectrophotometry, spectrofluorimetry, nuclear magnetic resonance, or radioactive procedures. Kinetic values are conveniently obtained using a Lineweaver-Burk or Eadie-Hofstee plot.

F. Polynucleotides Complementary to the Polynucleotides of (A)-(E)

As indicated in (f), above, the present invention provides isolated nucleic acids comprising polynucleotides complementary to the polynucleotides of paragraphs A-E, above. As those of skill in the art will recognize, complementary sequences base-pair throughout the entirety of their length with the polynucleotides of sections (A)-(E) (i.e., have 100% sequence identity over their entire length). Complementary bases associate through hydrogen bonding in double stranded nucleic acids. For example, the following base pairs are complementary: guanine and cytosine; adenine and thymine; and adenine and uracil.

G. Polynucleotides Which are Subsequences of the Polynucleotides of (A)-(F)

As indicated in (g), above, the present invention provides isolated nucleic acids comprising polynucleotides which comprise at least 15 contiguous bases from the polynucleotides of sections (A) through (F) as discussed above. The length of the polynucleotide is given as an integer selected from the group consisting of from at least 15 to the length of the nucleic acid sequence from which the polynucleotide is a subsequence of. Thus, for example, polynucleotides of the present invention are inclusive of polynucleotides comprising at least 15, 20, 25, 30, 40, 50, 60, 75, or 100 contiguous nucleotides in length from the polynucleotides of (A)-(F). Optionally, the number of such subsequences encoded by a polynucleotide of the instant embodiment can be any integer selected from the group consisting of from 1 to 20, such as 2, 3, 4, or 5. The subsequences can be separated by any integer of nucleotides from 1 to the number of nucleotides in the sequence such as at least 5, 10, 15, 25, 50, 100, or 200 nucleotides.

Subsequences can be made by in vitro synthetic, in vitro biosynthetic, or in vivo recombinant methods. In optional embodiments, subsequences can be made by nucleic acid amplification. For example, nucleic acid primers will be constructed to selectively hybridize to a sequence (or its complement) within, or co-extensive with, the coding region.

The subsequences of the present invention can comprise structural characteristics of the sequence from which it is derived. Alternatively, the subsequences can lack certain structural characteristics of the larger sequence from which it is derived such as a poly (A) tail. Optionally, a subsequence from a polynucleotide encoding a polypeptide having at least one epitope in common with a prototype polypeptide sequence as provided in (a), above, may encode an epitope in common with the prototype sequence. Alternatively, the subsequence may not encode an epitope in common with the prototype sequence but can be used to isolate the larger sequence by, for example, nucleic acid hybridization with the sequence from which it is derived. Subsequences can be used to modulate or detect gene expression by introducing into the subsequences compounds which bind, intercalate, cleave and/or crosslink to nucleic acids. Exemplary compounds include acridine, psoralen, phenanthroline, naphthoquinone, daunomycin or chloroethylaminoaryl conjugates.

H. Polynucleotides From a Full-length Enriched cDNA Library Having the Physico-Chemical Property of Selectively Hybridizing to a Polynucleotide of (A)-(G)

As indicated in (h), above, the present invention provides an isolated polynucleotide from a full-length enriched cDNA library having the physico-chemical property of selectively hybridizing to a polynucleotide of paragraphs (A), (B), (C), (D), (E), (F), or (G) as discussed above. Methods of constructing full-length enriched cDNA libraries are known in the art and discussed briefly below. The cDNA library comprises at least 50% to 95% full-length sequences (for example, at least 50%, 60%, 70%, 80%, 90%, or 95% full-length sequences). The cDNA library can be constructed from a variety of tissues from a monocot or dicot at a variety of developmental stages. Exemplary species include maize, wheat, rice, canola, soybean, cotton, sorghum, sunflower, alfalfa, oats, sugar cane, millet, barley, and rice. Methods of selectively hybridizing, under selective hybridization conditions, a polynucleotide from a full-length enriched library to a polynucleotide of the present invention are known to those of ordinary skill in the art. Any number of stringency conditions can be employed to allow for selective hybridization. In optional embodiments, the stringency allows for selective hybridization of sequences having at least 70%, 75%, 80%, 85%, 90%, 95%, or 98% sequence identity over the length of the hybridized region. Full-length enriched cDNA libraries can be normalized to increase the representation of rare sequences.

I. Polynucleotide Products Made by a cDNA Isolation Process

As indicated in (I), above, the present invention provides an isolated polynucleotide made by the process of: 1) providing a full-length enriched nucleic acid library, 2) selectively hybridizing the polynucleotide to a polynucleotide of paragraphs (A), (B), (C), (D), (E), (F), (G), or (H) as discussed above, and thereby isolating the polynucleotide from the nucleic acid library. Full-length enriched nucleic acid libraries are constructed as discussed in paragraph (G) and below. Selective hybridization conditions are as discussed in paragraph (G). Nucleic acid purification procedures are well known in the art. Purification can be conveniently accomplished using solid-phase methods; such methods are well known to those of skill in the art and kits are available from commercial suppliers such as Advanced Biotechnologies (Surrey, UK). For example, a polynucleotide of paragraphs (A)-(H) can be immobilized to a solid support such as a membrane, bead, or particle. See, e.g., U.S. Pat. No. 5,667, 976. The polynucleotide product of the present process is selectively hybridized to an immobilized polynucleotide and the solid support is subsequently isolated from non-hybridized polynucleotides by methods including, but not limited to, centrifugation, magnetic separation, filtration, electrophoresis, and the like.

Construction of Nucleic Acids

The isolated nucleic acids of the present invention can be made using (a) standard recombinant methods, (b) synthetic techniques, or combinations thereof. In some embodiments, the polynucleotides of the present invention will be cloned, amplified, or otherwise constructed from a monocot such as corn, rice, or wheat, or a dicot such as soybean.

The nucleic acids may conveniently comprise sequences in addition to a polynucleotide of the present invention. For example, a multi-cloning site comprising one or more endonuclease restriction sites may be inserted into the nucleic acid to aid in isolation of the polynucleotide. Also, translatable sequences may be inserted to aid in the isolation of the translated polynucleotide of the present invention. For example, a hexa-histidine marker sequence provides a convenient means to purify the proteins of the present invention. A polynucleotide of the present invention can be attached to a vector, adapter, or linker for cloning and/or expression of a polynucleotide of the present invention. Additional sequences may be added to such cloning and/or expression sequences to optimize their function in cloning and/or expression, to aid in isolation of the polynucleotide, or to improve the introduction of the polynucleotide into a cell. Typically, the length of a nucleic acid of the present invention less the length of its polynucleotide of the present invention is less than 20 kilobase pairs, often less than 15 kb, and frequently less than 10 kb. Use of cloning vectors, expression vectors, adapters, and linkers is well known and extensively described in the art. For a description of various nucleic acids see, for example, Stratagene Cloning Systems, Catalogs 1999 (La Jolla, Calif.); and, Amersham Life Sciences, Inc, Catalog '99 (Arlington Heights, Ill.).

A. Recombinant Methods for Constructing Nucleic Acids

The isolated nucleic acid compositions of this invention, such as RNA, cDNA, genomic DNA, or a hybrid thereof, can be obtained from plant biological sources using any number of cloning methodologies known to those of skill in the art. In some embodiments, oligonucleotide probes which selectively hybridize, under stringent conditions, to the polynucleotides of the present invention are used to identify the desired sequence in a cDNA or genomic DNA library. Isolation of RNA, and construction of cDNA and genomic libraries is well known to those of ordinary skill in the art. See, e.g., *Plant Molecular Biology: A Laboratory Manual*, Clark, Ed., Springer-Verlag, Berlin (1997); and, *Current Protocols in Molecular Biology*, Ausubel et al., Eds., Greene Publishing and Wiley-Interscience, New York (1995).

A1. Full-Length Enriched cDNA Libraries

A number of cDNA synthesis protocols have been described which provide enriched full-length cDNA libraries. Enriched full-length cDNA libraries are constructed to comprise at least 600%, and more preferably at least 70%, 80%, 90% or 95% full-length inserts amongst clones containing inserts. The length of insert in such libraries can be at least 2, 3, 4, 5, 6, 7, 8, 9, 10 or more kilobase pairs. Vectors to accommodate inserts of these sizes are known in the art and available commercially. See, e.g., Stratagene's lambda ZAP Express (cDNA cloning vector with 0 to 12 kb cloning capacity). An exemplary method of constructing a greater than 95% pure full-length cDNA library is described by Caminci et al., *Genomics*, 37:327-336 (1996). Other methods for producing full-length libraries are known in the art. See, e.g., Edery et al., *Mol. Cell Biol.*, 15(6):3363-3371 (1995); and, PCT Application WO 96/34981.

A2. Normalized or Subtracted cDNA Libraries

A non-normalized cDNA library represents the mRNA population of the tissue it was made from. Since unique clones are out-numbered by clones derived from highly expressed genes their isolation can be laborious. Normalization of a cDNA library is the process of creating a library in which each clone is more equally represented. Construction of normalized libraries is described in Ko, *Nucl. Acids. Res.*, 18(19):5705-5711 (1990); Patanjali et al., *Proc. Natl. Acad. U.S.A.*, 88:1943-1947 (1991); U.S. Pat. Nos. 5,482,685, 5,482,845, and 5,637,685. In an exemplary method described by Soares et al., normalization resulted in reduction of the abundance of clones from a range of four orders of magnitude to a narrow range of only 1 order of magnitude. *Proc. Natl. Acad. Sci. USA*, 91:9228-9232 (1994).

Subtracted cDNA libraries are another means to increase the proportion of less abundant cDNA species. In this procedure, cDNA prepared from one pool of mRNA is depleted of sequences present in a second pool of mRNA by hybridization. The cDNA:mRNA hybrids are removed and the remaining un-hybridized cDNA pool is enriched for sequences unique to that pool. See, Foote et al. in, *Plant Molecular Biology: A Laboratory Manual*, Clark, Ed., Springer-Verlag, Berlin (1997); Kho and Zarbl, *Technique,* 3(2):58-63 (1991); Sive and St. John, *Nucl. Acids Res.,* 16(22):10937 (1988); *Current Protocols in Molecular Biology*, Ausubel et al., Eds., Greene Publishing and Wiley-Interscience, New York (1995); and Swaroop et al., *Nucl. Acids Res.,* 19)$_8$):1954 (1991). cDNA subtraction kits are commercially available. See, e.g., PCR-Select (Clontech, Palo Alto, Calif.).

To construct genomic libraries, large segments of genomic DNA are generated by fragmentation, e.g. using restriction endonucleases, and are ligated with vector DNA to form concatemers that can be packaged into the appropriate vector. Methodologies to accomplish these ends, and sequencing methods to verify the sequence of nucleic acids are well known in the art. Examples of appropriate molecular biological techniques and instructions sufficient to direct persons of skill through many construction, cloning, and screening methodologies are found in Sambrook et al., *Molecular Cloning: A Laboratory Manual,* 2nd Ed., Cold Spring Harbor Laboratory Vols. 1-3 (1989), *Methods in Enzymology*, Vol. 152: *Guide to Molecular Cloning Techniques*, Berger and Kimmel, Eds., San Diego: Academic Press, Inc. (1987), *Current Protocols in Molecular Biology*, Ausubel et al., Eds., Greene Publishing and Wiley-Interscience, New York (1995); *Plant Molecular Biology: A Laboratory Manual*, Clark, Ed., Springer-Verlag, Berlin (1997). Kits for construction of genomic libraries are also commercially available.

The cDNA or genomic library can be screened using a probe based upon the sequence of a polynucleotide of the present invention such as those disclosed herein. Probes may be used to hybridize with genomic DNA or cDNA sequences to isolate homologous genes in the same or different plant species. Those of skill in the art will appreciate that various degrees of stringency of hybridization can be employed in the assay; and either the hybridization or the wash medium can be stringent.

The nucleic acids of interest can also be amplified from nucleic acid samples using amplification techniques. For instance, polymerase chain reaction (PCR) technology can be used to amplify the sequences of polynucleotides of the present invention and related genes directly from genomic DNA or cDNA libraries. PCR and other in vitro amplification methods may also be useful, for example, to clone nucleic acid sequences that code for proteins to be expressed, to make nucleic acids to use as probes for detecting the presence of the desired mRNA in samples, for nucleic acid sequencing, or for other purposes. The T4 gene 32 protein (Boehringer Mannheim) can be used to improve yield of long PCR products.

PCR-based screening methods have been described. Wilfinger et al. describe a PCR-based method in which the longest cDNA is identified in the first step so that incomplete clones can be eliminated from study. *BioTechniques*, 22(3): 481-486 (1997). Such methods are particularly effective in combination with a full-length cDNA construction methodology, above.

B. Synthetic Methods for Constructing Nucleic Acids

The isolated nucleic acids of the present invention can also be prepared by direct chemical synthesis by methods such as the phosphotriester method of Narang et al., *Meth. Enzymol.* 68:90-99 (1979); the phosphodiester method of Brown et al., *Meth. Enzymol.* 68:109-151 (1979); the diethylphosphoramidite method of Beaucage et al., *Tetra. Lett.* 22:1859-1862 (1981); the solid phase phosphoramidite triester method described by Beaucage and Caruthers, *Tetra. Letts.* 22(20): 1859-1862 (1981), e.g., using an automated synthesizer, e.g., as described in Needham-VanDevanter et al., *Nucleic Acids Res.*, 12:6159-6168 (1984); and, the solid support method of U.S. Pat. No. 4, 458, 066. Chemical synthesis generally produces a single stranded oligonucleotide. This may be converted into double stranded DNA by hybridization with a complementary sequence, or by polymerization with a DNA polymerase using the single strand as a template. One of skill will recognize that while chemical synthesis of DNA is best employed for sequences of about 100 bases or less, longer sequences may be obtained by the ligation of shorter sequences.

Recombinant Expression Cassettes

The present invention further provides recombinant expression cassettes comprising a nucleic acid of the present invention. A nucleic acid sequence coding for the desired polypeptide of the present invention, for example a cDNA or a genomic sequence encoding a full length polypeptide of the present invention, can be used to construct a recombinant expression cassette which can be introduced into the desired host cell. A recombinant expression cassette will typically comprise a polynucleotide of the present invention operably linked to transcriptional initiation regulatory sequences which will direct the transcription of the polynucleotide in the intended host cell, such as tissues of a transformed plant.

For example, plant expression vectors may include (1) a cloned plant gene under the transcriptional control of 5' and 3' regulatory sequences and (2) a dominant selectable marker. Such plant expression vectors may also contain, if desired, a promoter regulatory region (e.g., one conferring inducible or constitutive, environmentally- or developmentally-regulated, or cell- or tissue-specific/selective expression), a transcription initiation start site, a ribosome binding site, an RNA processing signal, a transcription termination site, and/or a polyadenylation signal.

A plant promoter fragment can be employed which will direct expression of a polynucleotide of the present invention in all tissues of a regenerated plant. Such promoters are referred to herein as "constitutive" promoters and are active under most environmental conditions and states of development or cell differentiation. Examples of constitutive promoters include the cauliflower mosaic virus (CaMV) 35S transcription initiation region, the 1'- or 2'-promoter derived from T-DNA of *Agrobacterium tumefaciens*, the ubiquitin 1 promoter, the Smas promoter, the cinnamyl alcohol dehydrogenase promoter (U.S. Pat. No. 5, 683, 439), the Nos promoter, the pemu promoter, the rubisco promoter, and the GRP1-8 promoter.

Alternatively, the plant promoter can direct expression of a polynucleotide of the present invention in a specific tissue or may be otherwise under more precise environmental or developmental control. Such promoters are referred to here as "inducible" promoters. Environmental conditions that may effect transcription by inducible promoters include pathogen attack, anaerobic conditions, or the presence of light. Examples of inducible promoters are the Adh1 promoter which is inducible by hypoxia or cold stress, the Hsp70 promoter which is inducible by heat stress, and the PPDK promoter which is inducible by light.

Examples of promoters under developmental control include promoters that initiate transcription only, or preferentially, in certain tissues, such as leaves, roots, fruit, seeds, or flowers. Exemplary promoters include the another specific promoter 5126 (U.S. Pat. Nos. 5,689,049 and 5,689,051), glob-1 promoter, and gamma-zein promoter. The operation of a promoter may also vary depending on its location in the genome. Thus, an inducible promoter may become fully or partially constitutive in certain locations.

Both heterologous and non-heterologous (i.e., endogenous) promoters can be employed to direct expression of the nucleic acids of the present invention. These promoters can also be used, for example, in recombinant expression cassettes to drive expression of antisense nucleic acids to reduce, increase, or alter concentration and/or composition of the proteins of the present invention in a desired tissue. Thus, in some embodiments, the nucleic acid construct will comprise a promoter, functional in a plant cell, operably linked to a polynucleotide of the present invention. Promoters useful in these embodiments include the endogenous promoters driving expression of a polypeptide of the present invention.

In some embodiments, isolated nucleic acids which serve as promoter or enhancer elements can be introduced in the appropriate position (generally upstream) of a non-heterologous form of a polynucleotide of the present invention so as to up or down regulate expression of a polynucleotide of the present invention. For example, endogenous promoters can be altered in vivo by mutation, deletion, and/or substitution (see, Kmiec, U.S. Pat. No. 5,565,350; Zarling et al., PCT/US93/03868), or isolated promoters can be introduced into a plant cell in the proper orientation and distance from a cognate gene of a polynucleotide of the present invention so as to control the expression of the gene. Gene expression can be modulated under conditions suitable for plant growth so as to alter the total concentration and/or alter the composition of the polypeptides of the present invention in plant cell. Thus, the present invention provides compositions, and methods for making, heterologous promoters and/or enhancers operably linked to a native, endogenous (i.e., non-heterologous) form of a polynucleotide of the present invention.

If polypeptide expression is desired, it is generally desirable to include a polyadenylation region at the 3'-end of a polynucleotide coding region. The polyadenylation region can be derived from the natural gene, from a variety of other plant genes, or from T-DNA. The 3' end sequence to be added can be derived from, for example, the nopaline synthase or octopine synthase genes, or alternatively from another plant gene, or less preferably from any other eukaryotic gene.

An intron sequence can be added to the 5' untranslated region or the coding sequence of the partial coding sequence to increase the amount of the mature message that accumulates in the cytosol. Inclusion of a spliceable intron in the transcription unit in both plant and animal expression constructs has been shown to increase gene expression at both the mRNA and protein levels up to 1000-fold. Buchman and Berg, *Mol. Cell Biol.* 8:4395-4405 (1988); Callis et al., *Genes Dev.* 1:1183-1200 (1987). Such intron enhancement of gene expression is typically greatest when placed near the 5' end of the transcription unit. Use of maize introns Adh1-S intron 1, 2, and 6, the Bronze-1 intron are known in the art. See generally, *The Maize Handbook*, Chapter 116, Freeling and Walbot, Eds., Springer, New York (1994). The vector comprising the sequences from a polynucleotide of the present invention will typically comprise a marker gene which confers a selectable phenotype on plant cells. Typical vectors useful for expression of genes in higher plants are well known in the art and include vectors derived from the tumor-inducing (Ti) plasmid of *Agrobacterium tumefaciens* described by Rogers et al., *Meth. in Enzymol.*, 153:253-277 (1987).

A polynucleotide of the present invention can be expressed in either sense or anti-sense orientation as desired. It will be appreciated that control of gene expression in either sense or anti-sense orientation can have a direct impact on the observable plant characteristics. Antisense technology can be conveniently used to inhibit gene expression in plants. To accomplish this, a nucleic acid segment from the desired gene is cloned and operably linked to a promoter such that the antisense strand of RNA will be transcribed. The construct is then transformed into plants and the antisense strand of RNA is produced. In plant cells, it has been shown that antisense RNA inhibits gene expression by preventing the accumulation of mRNA which encodes the enzyme of interest, see, e.g., Sheehy et al., *Proc. Nat'l. Acad. Sci. (USA)* 85:8805-8809 (1988); and Hiatt et al., U.S. Pat. No. 4,801,340.

Another method of suppression is sense suppression (i.e., co-supression). Introduction of nucleic acid configured in the sense orientation has been shown to be an effective means by which to block the transcription of target genes. For an example of the use of this method to modulate expression of endogenous genes see, Napoli et al., *The Plant Cell* 2:279-289 (1990) and U.S. Pat. No. 5,034,323.

Catalytic RNA molecules or ribozymes can also be used to inhibit expression of plant genes. It is possible to design ribozymes that specifically pair with virtually any target RNA and cleave the phosphodiester backbone at a specific location, thereby functionally inactivating the target RNA. In carrying out this cleavage, the ribozyme is not itself altered, and is thus capable of recycling and cleaving other molecules, making it a true enzyme. The inclusion of ribozyme sequences within antisense RNAs confers RNA-cleaving activity upon them, thereby increasing the activity of the constructs. The design and use of target RNA-specific ribozymes is described in Haseloff et al., *Nature* 334:585-591 (1988).

A variety of cross-linking agents, alkylating agents and radical generating species as pendant groups on polynucleotides of the present invention can be used to bind, label, detect, and/or cleave nucleic acids. For example, Vlassov, V. V., et al., *Nucleic Acids Res* (1986) 14:4065-4076, describe covalent bonding of a single-stranded DNA fragment with alkylating derivatives of nucleotides complementary to target sequences. A report of similar work by the same group is that by Knorre, D. G. et al., *Biochimie* (1985) 67:785-789. Iverson and Dervan also showed sequence-specific cleavage of single-stranded DNA mediated by incorporation of a modified nucleotide which was capable of activating cleavage (*J Am Chem Soc* (1987) 109:1241-1243). Meyer, R. B. et al., *J Am Chem Soc* (1989) 111:8517-8519, effect covalent crosslinking to a target nucleotide using an alkylating agent complementary to the single-stranded target nucleotide sequence. A photoactivated crosslinking to single-stranded oligonucleotides mediated by psoralen was disclosed by Lee, B. L. et al., *Biochemistry* (1988) 27:3197-3203. Use of crosslinking in triple-helix forming probes was also disclosed by Home et al., *J Am Chem Soc* (1990) 112:2435-2437. Use of N4, N4-ethanocytosine as an alkylating agent to crosslink to single-stranded oligonucleotides has also been described by Webb and Matteucci, *J Am Chem Soc* (1986) 108:2764-2765; *Nucleic Acids Res* (1986) 14:7661-7674; Feteritz et al., *J. Am. Chem. Soc.* 113:4000 (1991). Various compounds to bind, detect, label, and/or cleave nucleic acids are known in the art. See, for example, U.S. Pat. Nos. 5,543,507; 5,672, 593; 5,484,908; 5,256,648; and, 5,681,941.

Proteins

The isolated proteins of the present invention comprise a polypeptide having at least 10 amino acids from a polypeptide of the present invention (or conservative variants thereof) such as those encoded by any one of the polynucleotides of the present invention as discussed more fully above (e.g., Table 1). The proteins of the present invention or variants thereof can comprise any number of contiguous amino acid residues from a polypeptide of the present invention, wherein that number is selected from the group of integers consisting of from 10 to the number of residues in a full-length polypeptide of the present invention. Optionally, this subsequence of contiguous amino acids is at least 15, 20, 25, 30, 35, or 40 amino acids in length, often at least 50, 60, 70, 80, or 90 amino acids in length. Further, the number of such subsequences can be any integer selected from the group consisting of from 1 to 20, such as 2, 3, 4, or 5.

The present invention further provides a protein comprising a polypeptide having a specified sequence identity/similarity with a polypeptide of the present invention. The percentage of sequence identity/similarity is an integer selected from the group consisting of from 50 to 99. Exemplary sequence identity/similarity values include 60%, 65%, 70%, 75%, 80%, 85%, 90%, and 95%. Sequence identity can be determined using, for example, the GAP, CLUSTALW, or BLAST algorithms.

As those of skill will appreciate, the present invention includes, but is not limited to, catalytically active polypeptides of the present invention (i.e., enzymes). Catalytically active polypeptides have a specific activity of at least 20%, 30%, or 40%, and preferably at least 50%, 60%, or 70%, and most preferably at least 80%, 90%, or 95% that of the native (non-synthetic), endogenous polypeptide. Further, the substrate specificity ($k_{cat}/K_m$) is optionally substantially similar to the native (non-synthetic), endogenous polypeptide. Typically, the $K_m$ will be at least 30%, 40%, or 50%, that of the native (non-synthetic), endogenous polypeptide; and more preferably at least 60%, 70%, 80%, or 90%. Methods of assaying and quantifying measures of enzymatic activity and substrate specificity ($k_{cat}/K_m$), are well known to those of skill in the art.

Generally, the proteins of the present invention will, when presented as an immunogen, elicit production of an antibody specifically reactive to a polypeptide of the present invention. Further, the proteins of the present invention will not bind to antisera raised against a polypeptide of the present invention which has been fully immunosorbed with the same polypeptide. Immunoassays for determining binding are well known to those of skill in the art. A preferred immunoassay is a competitive immunoassay. Thus, the proteins of the present invention can be employed as immunogens for constructing antibodies immunoreactive to a protein of the present invention for such exemplary utilities as immunoassays or protein purification techniques.

Expression of Proteins in Host Cells

Using the nucleic acids of the present invention, one may express a protein of the present invention in a recombinantly engineered cell such as bacteria, yeast, insect, mammalian, or preferably plant cells. The cells produce the protein in a non-natural condition (e.g., in quantity, composition, location, and/or time), because they have been genetically altered through human intervention to do so.

It is expected that those of skill in the art are knowledgeable in the numerous expression systems available for expression of a nucleic acid encoding a protein of the present invention. No attempt to describe in detail the various methods known for the expression of proteins in prokaryotes or eukaryotes will be made.

In brief summary, the expression of isolated nucleic acids encoding a protein of the present invention will typically be achieved by operably linking, for example, the DNA or cDNA to a promoter (which is either constitutive or regulatable), followed by incorporation into an expression vector. The vectors can be suitable for replication and integration in either prokaryotes or eukaryotes. Typical expression vectors contain transcription and translation terminators, initiation sequences, and promoters useful for regulation of the expression of the DNA encoding a protein of the present invention. To obtain high level expression of a cloned gene, it is desirable to construct expression vectors which contain, at the minimum, a strong promoter to direct transcription, a ribosome binding site for translational initiation, and a transcription/translation terminator. One of skill would recognize that modifications can be made to a protein of the present invention without diminishing its biological activity. Some modifications may be made to facilitate the cloning, expression, or incorporation of the targeting molecule into a fusion protein. Such modifications are well known to those of skill in the art and include, for example, a methionine added at the amino terminus to provide an initiation site, or additional amino acids (e.g., poly H is) placed on either terminus to create conveniently located purification sequences. Restriction sites or termination codons can also be introduced.

Synthesis of Proteins

The proteins of the present invention can be constructed using non-cellular synthetic methods. Solid phase synthesis of proteins of less than about 50 amino acids in length may be accomplished by attaching the C-terminal amino acid of the sequence to an insoluble support followed by sequential addition of the remaining amino acids in the sequence. Techniques for solid phase synthesis are described by Barany and Merrifield, Solid-Phase Peptide Synthesis, pp. 3-284 in *The Peptides: Analysis, Synthesis, Biology*. Vol. 2: Special Methods in Peptide Synthesis, Part A.; Merrifield et al., *J. Am. Chem. Soc.* 85:2149-2156 (1963), and Stewart et al., *Solid Phase Peptide Synthesis*, 2nd ed., Pierce Chem. Co., Rockford, Ill. (1984). Proteins of greater length may be synthesized by condensation of the amino and carboxy termini of shorter fragments. Methods of forming peptide bonds by activation of a carboxy terminal end (e.g., by the use of the coupling reagent N, N'-dicycylohexylcarbodiimide) are known to those of skill.

Purification of Proteins

The proteins of the present invention may be purified by standard techniques well known to those of skill in the art. Recombinantly produced proteins of the present invention can be directly expressed or expressed as a fusion protein. The recombinant protein is purified by a combination of cell lysis (e.g., sonication, French press) and affinity chromatography. For fusion products, subsequent digestion of the fusion protein with an appropriate proteolytic enzyme releases the desired recombinant protein.

The proteins of this invention, recombinant or synthetic, may be purified to substantial purity by standard techniques well known in the art, including detergent solubilization, selective precipitation with such substances as ammonium sulfate, column chromatography, immunopurification methods, and others. See, for instance, R. Scopes, *Protein Purification Principles and Practice*, Springer-Verlag: New York (1982); Deutscher, *Guide to Protein Purification*, Academic Press (1990). For example, antibodies may be raised to the proteins as described herein. Purification from *E. coli* can be achieved following procedures described in U.S. Pat. No. 4,511,503. The protein may then be isolated from cells expressing the protein and further purified by standard protein chemistry techniques as described herein. Detection of the expressed protein is achieved by methods known in the art and include, for example, radioimmunoassays, Western blotting techniques or immunoprecipitation.

Introduction of Nucleic Acids into Host Cells

The method of introducing a nucleic acid of the present invention into a host cell is not critical to the instant invention. Transformation or transfection methods are conveniently used. Accordingly, a wide variety of methods have been developed to insert a DNA sequence into the genome of a host cell to obtain the transcription and/or translation of the sequence to effect phenotypic changes in the organism. Thus, any method which provides for effective introduction of a nucleic acid may be employed.

A. Plant Transformation

A nucleic acid comprising a polynucleotide of the present invention is optionally introduced into a plant. Generally, the polynucleotide will first be incorporated into a recombinant expression cassette or vector. Isolated nucleic acids of the present invention can be introduced into plants according to techniques known in the art. Techniques for transforming a wide variety of higher plant species are well known and described in the technical, scientific, and patent literature. See, for example, Weising et al., *Ann. Rev. Genet.* 22:421-477 (1988). For example, the DNA construct may be introduced directly into the genomic DNA of the plant cell using techniques such as electroporation, polyethylene glycol (PEG), poration, particle bombardment, silicon fiber delivery, or microinjection of plant cell protoplasts or embryogenic callus. See, e.g., Tomes et al., Direct DNA Transfer into Intact Plant Cells Via Microprojectile Bombardment. pp. 197-213 in Plant Cell, Tissue and Organ Culture, Fundamental Methods, eds. O. L. Gamborg and G. C. Phillips. Springer-Verlag Berlin Heidelberg New York, 1995; see, U.S. Pat. No. 5,990, 387. The introduction of DNA constructs using PEG precipitation is described in Paszkowski et al., *Embo J.* 3:2717-2722 (1984). Electroporation techniques are described in Fromm et al., *Proc. Natl. Acad. Sci.* (*USA*) 82:5824 (1985). Ballistic transformation techniques are described in Klein et al., *Nature* 327:70-73 (1987).

*Agrobacterium tumefaciens*-mediated transformation techniques are well described in the scientific literature. See, for example Horsch et al., *Science* 233:496-498 (1984); Fraley et al., *Proc. Natl. Acad. Sci.* (*USA*) 80:4803 (1983); and Plant Molecular Biology: A Laboratory Manual, Chapter 8, Clark, Ed., Springer-Verlag, Berlin (1997). The DNA constructs may be combined with suitable T-DNA flanking regions and introduced into a conventional *Agrobacterium tumefaciens* host vector. The virulence functions of the *Agrobacterium tumefaciens* host will direct the insertion of the construct and adjacent marker into the plant cell DNA when the cell is infected by the bacteria. See, U.S. Pat. No. 5, 591, 616. Although *Agrobacterium* is useful primarily in dicots, certain monocots can be transformed by *Agrobacterium*. For instance, *Agrobacterium* transformation of maize is described in U.S. Pat. No. 5,550,318.

Other methods of transfection or transformation include (1) *Agrobacterium rhizogenes*-mediated transformation (see, e.g., Lichtenstein and Fuller In: Genetic Engineering, vol. 6, PWJ Rigby, Ed., London, Academic Press, 1987; and Lichtenstein, C. P., and Draper, J., In: DNA Cloning, Vol. II, D. M. Glover, Ed., Oxford, IRI Press, 1985), Application PCT/US87/02512 (WO 88/02405 published Apr. 7, 1988) describes the use of *A. rhizogenes* strain A4 and its Ri plasmid along with *A. tumefaciens* vectors pARC8 or pARC16 (2) liposome-mediated DNA uptake (see e.g., Freeman et al., *Plant Cell Physiol.* 25:1353 (1984)), (3) the vortexing method (see e.g., Kindle, *Proc. Natl. Acad. Sci.*, (*USA*) 87:1228 (1990).

DNA can also be introduced into plants by direct DNA transfer into pollen as described by Zhou et al., *Methods in Enzymology*, 101:433 (1983); D. Hess, *Intern Rev. Cytol.*, 107:367 (1987); Luo et al., *Plant Mol. Biol. Reporter*, 6:165 (1988). Expression of polypeptide coding genes can be obtained by injection of the DNA into reproductive organs of a plant as described by Pena et al., *Nature*, 325:274 (1987). DNA can also be injected directly into the cells of immature embryos and the rehydration of desiccated embryos as described by Neuhaus et al., *Theor. Appl. Genet.*, 75:30 (1987); and Benbrook et al., in *Proceedings Bio Expo* 1986, Butterworth, Stoneham, Mass., pp. 27-54 (1986). A variety of plant viruses that can be employed as vectors are known in the art and include cauliflower mosaic virus (CaMV), geminivirus, brome mosaic virus, and tobacco mosaic virus.

B. Transfection of Prokaryotes, Lower Eukaryotes, and Animal Cells

Animal and lower eukaryotic (e.g., yeast) host cells are competent or rendered competent for transfection by various means. There are several well-known methods of introducing DNA into animal cells. These include: calcium phosphate precipitation, fusion of the recipient cells with bacterial protoplasts containing the DNA, treatment of the recipient cells with liposomes containing the DNA, DEAE dextran, electroporation, biolistics, and micro-injection of the DNA directly into the cells. The transfected cells are cultured by means well known in the art. Kuchler, R. J., *Biochemical Methods in Cell Culture and Virology*, Dowden, Hutchinson and Ross, Inc. (1977).

Transgenic Plant Regeneration

Plant cells which directly result or are derived from the nucleic acid introduction techniques can be cultured to regenerate a whole plant which possesses the introduced genotype. Such regeneration techniques often rely on manipulation of certain phytohormones in a tissue culture growth medium. Plants cells can be regenerated, e.g., from single cells, callus tissue or leaf discs according to standard plant tissue culture techniques. It is well known in the art that various cells, tissues, and organs from almost any plant can be successfully cultured to regenerate an entire plant. Plant regeneration from cultured protoplasts is described in Evans et al., *Protoplasts Isolation and Culture, Handbook of Plant Cell Culture*, Macmillan Publishing Company, New York, pp. 124-176 (1983); and Binding, *Regeneration of Plants, Plant Protoplasts*, CRC Press, Boca Raton, pp. 21-73 (1985).

The regeneration of plants from either single plant protoplasts or various explants is well known in the art. See, for example, *Methods for Plant Molecular Biology*, A. Weissbach and H. Weissbach, eds., Academic Press, Inc., San Diego, Calif. (1988). This regeneration and growth process includes the steps of selection of transformant cells and shoots, rooting the transformant shoots and growth of the plantlets in soil. For maize cell culture and regeneration see generally, *The Maize Handbook*, Freeling and Walbot, Eds., Springer, New York (1994); *Corn and Corn Improvement*, $3^{rd}$ edition, Sprague and Dudley Eds., American Society of Agronomy, Madison, Wis. (1988). For transformation and regeneration of maize see, Gordon-Kamm et al., *The Plant Cell*, 2:603-618 (1990).

The regeneration of plants containing the polynucleotide of the present invention and introduced by *Agrobacterium* from leaf explants can be achieved as described by Horsch et al., *Science*, 227:1229-1231 (1985). In this procedure, transformants are grown in the presence of a selection agent and in a medium that induces the regeneration of shoots in the plant species being transformed as described by Fraley et al., *Proc. Natl. Acad. Sci.* (*U.S.A.*), 80:4803 (1983). This procedure typically produces shoots within two to four weeks and these transformant shoots are then transferred to an appropriate root-inducing medium containing the selective agent and an antibiotic to prevent bacterial growth. Transgenic plants of the present invention may be fertile or sterile.

One of skill will recognize that after the recombinant expression cassette is stably incorporated in transgenic plants and confirmed to be operable, it can be introduced into other plants by sexual crossing. Any of a number of standard breeding techniques can be used, depending upon the species to be crossed. In vegetatively propagated crops, mature transgenic plants can be propagated by the taking of cuttings or by tissue culture techniques to produce multiple identical plants. Selection of desirable transgenics is made and new varieties are obtained and propagated vegetatively for commercial use. In seed propagated crops, mature transgenic plants can be self crossed to produce a homozygous inbred plant. The inbred plant produces seed containing the newly introduced heterologous nucleic acid. These seeds can be grown to produce plants that would produce the selected phenotype. Parts obtained from the regenerated plant, such as flowers, seeds, leaves, branches, fruit, and the like are included in the invention, provided that these parts comprise cells comprising the isolated nucleic acid of the present invention. Progeny and variants, and mutants of the regenerated plants are also included within the scope of the invention, provided that these parts comprise the introduced nucleic acid sequences.

Transgenic plants expressing a polynucleotide of the present invention can be screened for transmission of the nucleic acid of the present invention by, for example, standard immunoblot and DNA detection techniques. Expression at the RNA level can be determined initially to identify and quantitate expression-positive plants. Standard techniques for RNA analysis can be employed and include PCR amplification assays using oligonucleotide primers designed to amplify only the heterologous RNA templates and solution hybridization assays using heterologous nucleic acid-specific probes. The RNA-positive plants can then analyzed for protein expression by Western immunoblot analysis using the specifically reactive antibodies of the present invention. In addition, in situ hybridization and immunocytochemistry according to standard protocols can be done using heterologous nucleic acid specific polynucleotide probes and antibodies, respectively, to localize sites of expression within transgenic tissue. Generally, a number of transgenic lines are usually screened for the incorporated nucleic acid to identify and select plants with the most appropriate expression profiles.

A preferred embodiment is a transgenic plant that is homozygous for the added heterologous nucleic acid; i.e., a transgenic plant that contains two added nucleic acid sequences, one gene at the same locus on each chromosome of a chromosome pair. A homozygous transgenic plant can be obtained by sexually mating (selfing) a heterozygous transgenic plant that contains a single added heterologous nucleic acid, germinating some of the seed produced and analyzing the resulting plants produced for altered expression of a polynucleotide of the present invention relative to a control plant (i.e., native, non-transgenic). Back-crossing to a parental plant and out-crossing with a non-transgenic plant are also contemplated.

Modulating Polypeptide Levels and/or Composition

The present invention further provides a method for modulating (i.e., increasing or decreasing) the concentration or ratio of the polypeptides of the present invention in a plant or part thereof. Modulation can be effected by increasing or decreasing the concentration and/or the ratio of the polypeptides of the present invention in a plant. The method comprises introducing into a plant cell a recombinant expression cassette comprising a polynucleotide of the present invention as described above to obtain a transgenic plant cell, culturing the transgenic plant cell under transgenic plant cell growing conditions, and inducing or repressing expression of a polynucleotide of the present invention in the transgenic plant for a time sufficient to modulate concentration and/or the ratios of the polypeptides in the transgenic plant or plant part.

In some embodiments, the concentration and/or ratios of polypeptides of the present invention in a plant may be modulated by altering, in vivo or in vitro, the promoter of a gene to up- or down-regulate gene expression. In some embodiments, the coding regions of native genes of the present invention can be altered via substitution, addition, insertion, or deletion to decrease activity of the encoded enzyme. See e.g., Kmiec, U.S. Pat. No. 5,565,350; Zarling et al., PCT/US93/03868. And in some embodiments, an isolated nucleic acid (e.g., a vector) comprising a promoter sequence is transfected into a plant cell. Subsequently, a plant cell comprising the promoter operably linked to a polynucleotide of the present invention is selected for by means known to those of skill in the art such as, but not limited to, Southern blot, DNA sequencing, or PCR analysis using primers specific to the promoter and to the gene and detecting amplicons produced therefrom. A plant or plant part altered or modified by the foregoing embodiments is grown under plant forming conditions for a time sufficient to modulate the concentration and/or ratios of polypeptides of the present invention in the plant. Plant forming conditions are well known in the art and discussed briefly, supra.

In general, concentration or the ratios of the polypeptides is increased or decreased by at least 5%, 10%, 20%, 30%, 40%, 50%, 60%, 70%, 80%, or 90% relative to a native control plant, plant part, or cell lacking the aforementioned recombinant expression cassette. Modulation in the present invention may occur during and/or subsequent to growth of the plant to the desired stage of development. Modulating nucleic acid expression temporally and/or in particular tissues can be controlled by employing the appropriate promoter operably linked to a polynucleotide of the present invention in, for example, sense or antisense orientation as discussed in greater detail, supra. Induction of expression of a polynucleotide of the present invention can also be controlled by exogenous administration of an effective amount of inducing compound. Inducible promoters and inducing compounds which activate expression from these promoters are well known in the art. In preferred embodiments, the polypeptides of the present invention are modulated in monocots, particularly maize.

UTRs and Codon Preference

In general, translational efficiency has been found to be regulated by specific sequence elements in the 5' non-coding or untranslated region (5' UTR) of the RNA. Positive sequence motifs include translational initiation consensus sequences (Kozak, *Nucleic Acids Res.* 15:8125 (1987)) and the 7-methylguanosine cap structure (Drummond et al., *Nucleic Acids Res.* 13:7375 (1985)). Negative elements include stable intramolecular 5' UTR stem-loop structures (Muesing et al., *Cell* 48:691 (1987)) and AUG sequences or short open reading frames preceded by an appropriate AUG in the 5' UTR (Kozak, supra, Rao et al., *Mol. and Cell Biol.* 8:284 (1988)). Accordingly, the present invention provides 5' and/or 3' untranslated regions for modulation of translation of heterologous coding sequences.

Further, the polypeptide-encoding segments of the polynucleotides of the present invention can be modified to alter codon usage. Altered codon usage can be employed to alter translational efficiency and/or to optimize the coding sequence for expression in a desired host such as to optimize the codon usage in a heterologous sequence for expression in maize. Codon usage in the coding regions of the polynucleotides of the present invention can be analyzed statistically using commercially available software packages such as "Codon Preference" available from the University of Wisconsin Genetics Computer Group (see Devereaux et al., *Nucleic Acids Res.* 12:387-395 (1984)) or MacVector 4.1 (Eastman Kodak Co., New Haven, Conn.). Thus, the present invention provides a codon usage frequency characteristic of the coding region of at least one of the polynucleotides of the present invention. The number of polynucleotides that can be used to determine a codon usage frequency can be any integer from 1 to the number of polynucleotides of the present invention as provided herein. Optionally, the polynucleotides will be full-length sequences. An exemplary number of sequences for statistical analysis can be at least 1, 5, 10, 20, 50, or 100.

Sequence Shuffling

The present invention provides methods for sequence shuffling using polynucleotides of the present invention, and compositions resulting therefrom. Sequence shuffling is described in PCT publication No. WO 97/20078. See also, Zhang, J.-H. et al., *Proc. Natl. Acad. Sci. USA* 94:4504-4509 (1997). Generally, sequence shuffling provides a means for generating libraries of polynucleotides having a desired characteristic which can be selected or screened for. Libraries of recombinant polynucleotides are generated from a population of related sequence polynucleotides which comprise sequence regions which have substantial sequence identity and can be homologously recombined in vitro or in vivo. The population of sequence-recombined polynucleotides comprises a subpopulation of polynucleotides which possess desired or advantageous characteristics and which can be selected by a suitable selection or screening method. The characteristics can be any property or attribute capable of being selected for or detected in a screening system, and may include properties of: an encoded protein, a transcriptional element, a sequence controlling transcription, RNA processing, RNA stability, chromatin conformation, translation, or other expression property of a gene or transgene, a replicative element, a protein-binding element, or the like, such as any feature which confers a selectable or detectable property. In some embodiments, the selected characteristic will be a decreased $K_m$ and/or increased $K_{cat}$ over the wild-type protein as provided herein. In other embodiments, a protein or polynucleotide generated from sequence shuffling will have a ligand binding affinity greater than the non-shuffled wild-type polynucleotide. The increase in such properties can be at least 110%, 120%, 130%, 140% or at least 150% of the wild-type value.

Generic and Consensus Sequences

Polynucleotides and polypeptides of the present invention further include those having: (a) a generic sequence of at least two homologous polynucleotides or polypeptides, respectively, of the present invention; and, (b) a consensus sequence of at least three homologous polynucleotides or polypeptides, respectively, of the present invention. The generic sequence of the present invention comprises each species of polypeptide or polynucleotide embraced by the generic polypeptide or polynucleotide sequence, respectively. The individual species encompassed by a polynucleotide having an amino acid or nucleic acid consensus sequence can be used to generate antibodies or produce nucleic acid probes or primers to screen for homologs in other species, genera, families, orders, classes, phyla, or kingdoms. For example, a polynucleotide having a consensus sequence from a gene family of *Zea mays* can be used to generate antibody or nucleic acid probes or primers to other Gramineae species such as wheat, rice, or sorghum. Alternatively, a polynucleotide having a consensus sequence generated from orthologous genes can be used to identify or isolate orthologs of other taxa. Typically, a polynucleotide having a consensus sequence will be at least 9, 10, 15, 20, 25, 30, or 40 amino acids in length, or 20, 30, 40, 50, 100, or 150 nucleotides in length. As those of skill in the art are aware, a conservative amino acid substitution can be used for amino acids which differ amongst aligned sequence but are from the same conservative substitution group as discussed above. Optionally, no more than 1 or 2 conservative amino acids are substituted for each 10 amino acid length of consensus sequence.

Similar sequences used for generation of a consensus or generic sequence include any number and combination of allelic variants of the same gene, orthologous, or paralogous sequences as provided herein. Optionally, similar sequences used in generating a consensus or generic sequence are identified using the BLAST algorithm's smallest sum probability (P(N)). Various suppliers of sequence-analysis software are listed in chapter 7 of *Current Protocols in Molecular Biology*, F. M. Ausubel et al., Eds., *Current Protocols*, a joint venture between Greene Publishing Associates, Inc. and John Wiley & Sons, Inc. (Supplement 30). A polynucleotide sequence is considered similar to a reference sequence if the smallest sum probability in a comparison of the test nucleic acid to the reference nucleic acid is less than about 0.1, more preferably less than about 0.01, or 0.001, and most preferably less than about 0.0001, or 0.00001. Similar polynucleotides can be aligned and a consensus or generic sequence generated using multiple sequence alignment software available from a number of commercial suppliers such as the Genetics Computer Group's (Madison, Wis.) PILEUP software, Vector NTI's (North Bethesda, Md.) ALIGNX, or Genecode's (Ann Arbor, Mich.) SEQUENCHER. Conveniently, default parameters of such software can be used to generate consensus or generic sequences.

Machine Applications

The present invention provides machines, articles of manufacture, and processes for identifying, modeling, or analyzing the polynucleotides and polypeptides of the present invention. Identification methods permit identification of homologues of the polynucleotides or polypeptides of the present invention while modeling and analysis methods permit recognition of structural or functional features of interest.

A. Machines: Data Processing Systems

In one embodiment, the present invention provides a machine having: 1) a memory comprising data representing at least one genetic sequence, 2) a genetic identification, analysis, or modeling program with access to the data, 3) a data processor which executes instructions according to the program using the genetic sequence or a subsequence thereof, and 4) an output for storing or displaying the results of the data processing.

The machine of the present invention is a data processing system, typically a digital computer. The term "computer" includes one or several desktop or portable computers, computer workstations, servers (including intranet or internet servers), mainframes, and any integrated system comprising any of the above irrespective of whether the processing, memory, input, or output of the computer is remote or local, as well as any networking interconnecting the modules of the computer. Data processing can thus be remote or distributed amongst several processors at one or multiple sites. The data processing system comprises a data processor, such as a central processing unit (CPU), which executes instructions according to an application program. As used herein, machines, articles of manufacture, and processes are exclusive of the machines, manufactures, and processes employed by the United States Patent and Trademark Office or the European Patent Office when data representing the sequence of a polypeptide or polynucleotide of the present invention is used for patentability searches.

The machine of the present invention includes a memory comprising data representing at least one genetic sequence. As used herein, "genetic sequence" refers to the primary sequence (i.e., amino acid or nucleotide sequence) of a polynucleotide or polypeptide of the present invention. The genetic sequence can represent a partial sequence from a full-length protein, genomic DNA, or full-length cDNA/mRNA. Nucleic acids or proteins comprising a genetic sequence that is identified, analyzed, or modeled according to the present invention can be cloned or synthesized.

As those of skill in the art will be aware, the form of memory of a machine of the present invention, or the particular embodiment of the computer readable medium, are not critical elements of the invention and can take a variety of forms. The memory of such a machine includes, but is not limited to, ROM, or RAM, or computer readable media such as, but not limited to, magnetic media such as computer disks or hard drives, or media such as CD-ROMs, DVDs, and the like. The memory comprising the data representing the genetic sequence includes main memory, a register, and a cache. In some embodiments the data processing system stores the data representing the genetic sequence in memory while processing the data and wherein successive portions of the data are copied sequentially into at least one register of the data processor for processing. Thus, the genetic sequence stored in memory can be a genetic sequence created during computer runtime or stored beforehand. The machine of the present invention includes a genetic identification, analysis, or modeling program (discussed below) with access to the data representing the genetic sequence. The program can be implemented in software or hardware.

The present invention further contemplates that the machine of the present invention will reference, directly or indirectly, a utility or function for the polynucleotide or polypeptide of the present invention. For example, the utility/function can be directly referenced as a data element in the machine and accessible by the program. Alternatively, the utility/function of the genetic can be indirectly referenced to an electronic or written record. The function or utility of the genetic sequence can be a function or utility for the genetic sequence, or the data representing the sequence (i.e., the genetic sequence data). Exemplary function or utilities for the genetic sequence include: 1) its name (per International Union of Biochemistry and Molecular Biology rules of nomenclature) or the function of the enzyme or protein represented by the genetic sequence, 2) the metabolic pathway that the protein represented by the genetic sequence participates in, 3) the substrate or product or structural role of the protein represented by the genetic sequence, or, 4) the phenotype (e.g., an agronomic or pharmacological trait) affected by modulating expression or activity of the protein represented by the genetic sequence.

The machine of the present invention also includes an output for displaying, printing, or recording the results of the identification, analysis, or modeling performed using a genetic sequence of the present invention. Exemplary outputs include monitors, printers, or various electronic storage mechanisms (e.g., floppy disks, hard drives, main memory) which can be used to display the results or employed as a means to input the stored data into a subsequent application or device.

In some embodiments, data representing a genetic sequence of the present invention is a data element within a data structure. The data structure may be defined by the computer programs that define the processes of identification, modeling, or analysis (see below) or it may be defined by the programming of separate data storage and retrieval programs subroutines or systems. Thus, the present invention provides a memory for storing a data structure that can be accessed by a computer programmed to implement a process for identification, analysis, or modeling of a genetic sequence. The data structure, stored within memory, is associated with the data representing the genetic sequence and reflects the underlying organization and structure of the genetic sequence to facilitate program access to data elements corresponding to logical sub-components of the genetic sequence. The data structure enables the genetic sequence to be identified, analyzed, or modeled. The underlying order and structure of a genetic sequence is data representing the higher order organization of the primary sequence. Such higher order structures affect transcription, translation, enzyme kinetics, or reflects structural domains or motifs. Exemplary logical sub-components which constitute the higher order organization of the genetic sequence include but are not limited to: restriction enzyme sites, endopeptidase sites, major grooves, minor grooves, beta-sheets, alpha helices, open reading frames (ORFs), 5' untranslated regions (UTRs), 3' UTRs, ribosome binding sites, glycosylation sites, signal peptide domains, intron-exon junctions, poly-A tails, transcription initiation sites, translation start sites, translation termination sites, methylation sites, zinc finger domains, modified amino acid sites, preproprotein-proprotein junctions, proprotein-protein junctions, transit peptide domains, single nucleotide polymorphisms (SNPs), simple sequence repeats (SSRs), restriction fragment length polymorphisms (RFLPs), insertion elements, transmembrane spanning regions, and stem-loop structures.

In another embodiment, the present invention provides a data processing system comprising at least one data structure in memory where the data structure supports the accession of data representing a genetic sequence of the present invention. The system also comprises at least one genetic identification, analysis, or modeling program which directs the execution of instructions by the system using the genetic sequence data to identify, analyze, or model at least one data element which is a logical sub-component of the genetic sequence. An output for the processing results is also provided.

B. Articles of Manufacture: Computer Readable Media

In one embodiment, the present invention provides a data structure in a computer readable medium that contains data representing a genetic sequence of the present invention. The data structure is organized to reflect the logical structuring of the genetic sequence, so that the sequence can be analyzed by software programs capable of accessing the data structure. In particular, the data structures of the present invention organize the genetic sequences of the present invention in a manner which allows software tools to perform an identification, analysis, or modeling using logical elements of each genetic sequence.

In a further embodiment, the present invention provides a machine-readable media containing a computer program and genetic sequence data. The program provides instructions sufficient to implement a process for effecting the identification, analysis, or modeling of the genetic sequence data. The media also includes a data structure reflecting the underlying organization and structure of the data to facilitate program access to data elements corresponding to logical sub-components of the genetic sequence, the data structure being inherent in the program and in the way in which the program organizes and accesses the data.

An example of a data structure resembles a layered hash table, where in one dimension the base content of the sequence is represented by a string of elements A, T, C, G and N. The direction from the 5' end to the 3' end is reflected by the order from the position 0 to the position of the length of the string minus one. Such a string, corresponding to a nucleotide sequence of interest, has a certain number of substrings, each of which is delimited by the string position of its 5' end and the string position of its 3' end within the parent string. In a second dimension, each substring is associated with or pointed to one or multiple attribute fields. Such attribute fields contain annotations to the region on the nucleotide sequence represented by the substring.

For example, a sequence under investigation is 520 bases long and represented by a string named SeqTarget. There is a minor groove in the 5' upstream non-coding region from position 12 to 38, which is identified as a binding site for an enhancer protein HM-A, which in turn will increase the transcription of the gene represented by SeqTarget. Here, the substring is represented as (12, 38) and has the following attributes: [upstream uncoded], [minor groove], [HM-A binding] and [increase transcription upon binding by HM-A]. Similarly, other types of information can be stored and structured in this manner, such as information related to the whole sequence, e.g., whether the sequence is a full length viral gene, a mammalian house keeping gene or an EST from clone X, information related to the 3' down stream non-coding region, e.g., hair pin structure, and information related to various domains of the coding region, e.g., Zinc finger.

This data structure is an open structure and is robust enough to accommodate newly generated data and acquired knowledge. Such a structure is also a flexible structure. It can be trimmed down to a 1-D string to facilitate data mining and analysis steps, such as clustering, repeat-masking, and HMM analysis. Meanwhile, such a data structure also can extend the associated attributes into multiple dimensions. Pointers can be established among the dimensioned attributes when needed to facilitate data management and processing in a comprehensive genomics knowledgebase. Furthermore, such a data structure is object-oriented. Polymorphism can be represented by a family or class of sequence objects, each of which has an internal structure as discussed above. The common traits are abstracted and assigned to the parent object, whereas each child object represents a specific variant of the family or class. Such a data structure allows data to be efficiently retrieved, updated and integrated by the software applications associated with the sequence database and/or knowledgebase.

C. Processes: Identification, Analysis, or Modeling

The present invention also provides a process of identifying, analyzing, or modeling data representing a genetic sequence of the present invention. The process comprises:
1) providing a machine having a hardware or software implemented genetic sequence identification, modeling, or analysis program with data representing a genetic sequence,
2) executing the program while granting it access to the genetic sequence data, and
3) displaying or outputting the results of the identification, analysis, or modeling. Data structures made by the processes of the present invention and embodied within a computer readable medium are also provided herein.

A further process of the present invention comprises providing a memory embodied with data representing a genetic sequence and developing within the memory a data structure associated with the data and reflecting the underlying organization and structure of the data to facilitate program access to data elements corresponding to logical sub-components of the sequence. A computer is programmed with a program containing instructions sufficient to implement the process for effecting the identification, analysis, or modeling of the genetic sequence and the program is executed on the computer while granting the program access to the data and to the data structure within the memory. The program results are outputted.

Identification, analysis, and modeling programs are well known in the art and available commercially. The program typically has at least one application to: 1) identify the structural role or enzymatic function of the gene which the genetic sequence encodes or is translated from, 2) analyzes and identifies higher order structures within the genetic sequence or, 3) model the physico-chemical properties of a genetic sequence of the present invention in a particular environment.

Included amongst the modeling/analysis tools are methods to: 1) recognize overlapping sequences (e.g., from a sequencing project) with a polynucleotide of the present invention and create an alignment called a "contig"; 2) identify restriction enzyme sites of a polynucleotide of the present invention; 3) identify the products of a T1 ribonuclease digestion of a polynucleotide of the present invention; 4) identify PCR primers with minimal self-complementarity; 5) compute pairwise distances between sequences in an alignment, reconstruct phylogentic trees using distance methods, and calculate the degree of divergence of two protein coding regions; 6) identify patterns such as coding regions, terminators, repeats, and other consensus patterns in polynucleotides of the present invention; 7) identify RNA secondary structure; 8) identify sequence motifs, isoelectric point, secondary structure, hydrophobicity, and antigenicity in polypeptides of the present invention; 9) translate polynucleotides of the present invention and backtranslate polypeptides of the present invention; and 10) compare two protein or nucleic acid sequences and identifying points of similarity or dissimilarity between them.

Identification of the function/utility of a genetic sequence is typically achieved by comparative analysis to a gene/protein database and establishing the genetic sequence as a candidate homologue (i.e., ortholog or paralog) of a gene/protein of known function/utility. A candidate homologue has statistically significant probability of having the same biological function (e.g., catalyzes the same reaction, binds to homologous proteins/nucleic acids, has a similar structural role) as the reference sequence to which it is compared. Sequence identity/similarity is frequently employed as a criterion to identify candidate homologues. In the same vein, genetic sequences of the present invention have utility in identifying homologs in animals or other plant species, particularly those in the family Gramineae such as, but not limited to, sorghum, wheat, or rice. Function is frequently established on the basis of sequence identity/similarity.

Exemplary sequence comparison systems are provided for in sequence analysis software such as those provided by the Genetics Computer Group (Madison, Wis.) or InforMax (Bethesda, Md.), or Intelligenetics (Mountain View, Calif.). Optionally, sequence comparison is established using the BLAST or GAP suite of programs. Generally, a smallest sum probability value (P(N)) of less than 0.1, or alternatively, less than 0.01, 0.001, 0.0001, or 0.00001 using the BLAST 2.0 suite of algorithms under default parameters identifies the test sequence as a candidate homologue (i.e., an allele, ortholog, or paralog) of a reference sequence. Those of skill in the art will recognize that a candidate homologue has an increased statistical probability of having the same or similar function as the gene/protein represented by the test sequence.

The software/hardware for effecting identification, analysis, or modeling can be produced independently or obtained from commercial suppliers. Exemplary identification, analysis, and modeling tools are provided in products such as InforMax's (Bethesda, Md.) Vector NTI Suite (Version 5.5), Intelligenetics' (Mountain View, Calif.) PC/Gene program, and Genetics Computer Group's (Madison, Wis.) Wisconsin Package (Version 10.0); these tools, and the functions they perform, (as provided and disclosed by the programs and accompanying literature) are incorporated herein by reference.

Detection of Nucleic Acids

The present invention further provides methods for detecting a polynucleotide of the present invention in a nucleic acid sample suspected of containing a polynucleotide of the present invention, such as a plant cell lysate, particularly a lysate of maize. In some embodiments, a cognate gene of a polynucleotide of the present invention or portion thereof can be amplified prior to the step of contacting the nucleic acid sample with a polynucleotide of the present invention. The nucleic acid sample is contacted with the polynucleotide to form a hybridization complex. The polynucleotide hybridizes under stringent conditions to a gene encoding a polypeptide of the present invention. Formation of the hybridization complex is used to detect a gene encoding a polypeptide of the present invention in the nucleic acid sample. Those of skill will appreciate that an isolated nucleic acid comprising a polynucleotide of the present invention should lack cross-hybridizing sequences in common with non-target genes that would yield a false positive result. Detection of the hybridization complex can be achieved using any number of well known methods. For example, the nucleic acid sample, or a portion thereof, may be assayed by hybridization formats including but not limited to, solution phase, solid phase, mixed phase, or in situ hybridization assays.

Detectable labels suitable for use in the present invention include any composition detectable by spectroscopic, radio-isotopic, photochemical, biochemical, immunochemical, electrical, optical or chemical means. Useful labels in the present invention include biotin for staining with labeled streptavidin conjugate, magnetic beads, fluorescent dyes, radiolabels, enzymes, and calorimetric labels. Other labels include ligands which bind to antibodies labeled with fluorophores, chemiluminescent agents, and enzymes. Labeling the nucleic acids of the present invention is readily achieved such as by the use of labeled PCR primers.

Although the present invention has been described in some detail by way of illustration and example for purposes of clarity of understanding, it will be obvious that certain changes and modifications may be practiced within the scope of the appended claims.

EXAMPLE 1

This example describes the construction of a cDNA library.

Total RNA can be isolated from maize tissues with TRIzol Reagent (Life Technology Inc., Gaithersburg, Md.) using a modification of the guanidine isothiocyanate/acid-phenol procedure described by Chomczynski and Sacchi (Chomczynski, P., and Sacchi, N. *Anal. Biochem.* 162, 156 (1987)). In brief, plant tissue samples is pulverized in liquid nitrogen before the addition of the TRIzol Reagent, and then further homogenized with a mortar and pestle. Addition of chloroform followed by centrifugation is conducted for separation of an aqueous phase and an organic phase. The total RNA is recovered by precipitation with isopropyl alcohol from the aqueous phase.

The selection of poly(A)+ RNA from total RNA can be performed using PolyATact system (Promega Corporation. Madison, Wis.). Biotinylated oligo(dT) primers are used to hybridize to the 3' poly(A) tails on mRNA. The hybrids are captured using streptavidin coupled to paramagnetic particles and a magnetic separation stand. The mRNA is then washed at high stringency conditions and eluted by RNase-free deionized water.

cDNA synthesis and construction of unidirectional cDNA libraries can be accomplished using the SuperScript Plasmid System (Life Technology Inc., Gaithersburg, Md.). The first strand of cDNA is synthesized by priming an oligo(dT) primer containing a Not I site. The reaction is catalyzed by SuperScript Reverse Transcriptase II at 45° C. The second strand of cDNA is labeled with alpha-$^{32}$P-dCTP and a portion of the reaction analyzed by agarose gel electrophoresis to determine cDNA sizes. cDNA molecules smaller than 500 base pairs and unligated adapters are removed by Sephacryl-S400 chromatography. The selected cDNA molecules are ligated into pSPORT1 vector in between of Not I and SalI sites.

Alternatively, cDNA libraries can be prepared by any one of many methods available. For example, the cDNAs may be introduced into plasmid vectors by first preparing the cDNA libraries in Uni-ZAP™ XR vectors according to the manufacturer's protocol (Stratagene Cloning Systems, La Jolla, Calif.). The Uni-ZAP™ XR libraries are converted into plasmid libraries according to the protocol provided by Stratagene. Upon conversion, cDNA inserts will be contained in the plasmid vector pBluescript. In addition, the cDNAs may be introduced directly into precut Bluescript II SK(+) vectors (Stratagene) using T4 DNA ligase (New England Biolabs), followed by transfection into DH10B cells according to the manufacturer's protocol (GIBCO BRL Products). Once the cDNA inserts are in plasmid vectors, plasmid DNAs are prepared from randomly picked bacterial colonies containing recombinant pBluescript plasmids, or the insert cDNA sequences are amplified via polymerase chain reaction using primers specific for vector sequences flanking the inserted cDNA sequences. Amplified insert DNAs or plasmid DNAs are sequenced in dye-primer sequencing reactions to generate partial cDNA sequences (expressed sequence tags or "ESTs"; see Adams et al., (1991) *Science* 252:1651-1656). The resulting ESTs are analyzed using a Perkin Elmer Model 377 fluorescent sequencer.

EXAMPLE 2

This method describes construction of a full-length enriched cDNA library.

An enriched full-length cDNA library can be constructed using one of two variations of the method of Caminci et al., *Genomics* 37:327-336, 1996. These variations are based on chemical introduction of a biotin group into the diol residue of the 5' cap structure of eukaryotic mRNA to select full-length first strand cDNA. The selection occurs by trapping the biotin residue at the cap sites using streptavidin-coated magnetic beads followed by RNase I treatment to eliminate incompletely synthesized cDNAs. Second strand cDNA is synthesized using established procedures such as those provided in Life Technologies' (Rockville, Md.) "SuperScript Plasmid System for cDNA Synthesis and Plasmid Cloning" kit. Libraries made by this method have been shown to contain 50% to 70% full-length cDNAs.

The first strand synthesis methods are detailed below. An asterisk denotes that the reagent was obtained from Life Technologies, Inc.

A. First Strand cDNA Synthesis Method 1 (With Trehalose)

| | |
|---|---|
| mRNA (10 ug) | 25 µl |
| *Not I primer (5 ug) | 10 µl |
| *5x 1st strand buffer | 43 µl |
| *0.1 m DTT | 20 µl |
| *dNTP mix 10 mm | 10 µl |
| BSA 10 ug/µl | 1 µl |
| Trehalose (saturated) | 59.2 µl |
| RNase inhibitor (Promega) | 1.8 µl |
| *Superscript II RT 200 u/µl | 20 µl |
| 100% glycerol | 18 µl |
| Water | 7 µl |

The mRNA and NotI primer are mixed and denatured at 65° C. for 10 min. They are then chilled on ice and other components added to the tube. Incubation is at 45° C. for 2 min. Twenty microliters of RT (reverse transcriptase) is added to the reaction and start program on the thermocycler (MJ Research, Waltham, Mass.):

| | | |
|---|---|---|
| Step 1 | 45° C. | 10 min |
| Step 2 | 45° C. | −0.3° C./cycle, 2 seconds/cycle |
| Step 3 | go to 2 for 33 cycles | |
| Step 4 | 35° C. | 5 min |
| Step 5 | 45° C. | 5 min |
| Step 6 | 45° C. | 0.2° C./cycle, 1 sec/cycle |
| Step 7 | go to 7 for 49 cycles | |
| Step 8 | 55° C. | 0.1° C./cycle, 12 sec/cycle |
| Step 9 | go to 8 for 49 cycles | |
| Step 10 | 55° C. | 2 min |
| Step 11 | 60° C. | 2 min |
| Step 12 | go to 11 for 9 times | |
| Step 13 | 4° C. forever | |
| Step 14 | end | |

B. First Strand cDNA Synthesis Method 2

| | |
|---|---|
| mRNA (10 µg) | 25 µl |
| water | 30 µl |
| *Not I adapter primer (5 µg) | 10 µl |
| 65° C. for 10 min, chill on ice, then add following reagents, | |
| *5× first buffer | 20 µl |
| *0.1M DTT | 10 µl |
| *10 mM dNTP mix | 5 µl |

Incubate at 45° C. for 2 min, then add 10 µl of *Superscript II RT (200 u/µl), start the following program:

| | |
|---|---|
| Step 1 | 45° C. for 6 sec, −0.1° C./cycle |
| Step 2 | go to 1 for 99 additional cycles |
| Step 3 | 35° C. for 5 min |
| Step 4 | 45° C. for 60 min |
| Step 5 | 50° C. for 10 min |
| Step 6 | 4° C. forever |
| Step 7 | end |

After the 1st strand cDNA synthesis, the DNA is extracted by phenol according to standard procedures, and then precipitated in NaOAc and ethanol, and stored in −20° C.

C. Oxidization of the Diol Group of mRNA for Biotin Labeling

First strand cDNA is spun down and washed once with 70% EtOH. The pellet resuspended in 23.2 µl of DEPC treated water and put on ice. Prepare 100 mM of NaIO4 freshly, and then add the following reagents:

| | |
|---|---|
| mRNA: 1st cDNA (start with 20 µg mRNA) | 46.4 µl |
| 100 mM NaIO4 (freshly made) | 2.5 µl |
| NaOAc 3M pH4.5 | 1.1 µl |

To make 100 mM NaIO4, use 21.39 µg of NaIO4 for 1 µl of water. Wrap the tube in a foil and incubate on ice for 45 min. After the incubation, the reaction is then precipitated in:

| | |
|---|---|
| 5M NaCl | 10 µl |
| 20% SDS | 0.5 µl |
| isopropanol | 61 µl |

Incubate on ice for at least 30 min, then spin it down at max speed at 4° C. for 30 min and wash once with 70% ethanol and then 80% EtOH.

D. Biotinylation of the mRNA Diol Group

Resuspend the DNA in 110 µl DEPC treated water, then add the following reagents:

| | |
|---|---|
| 20% SDS | 5 µl |
| 2 M NaOAc pH 6.1 | 5 µl |
| 10 mm biotin hydrazide (freshly made) | 300 µl |

Wrap in a foil and incubate at room temperature overnight.

E. RNase I Treatment

Precipitate DNA in:

| | |
|---|---|
| 5 M NaCl | 10 µl |
| 2 M NaOAc pH 6.1 | 75 µl |
| biotinylated mRNA:cDNA | 420 µl |
| 100% EtOH (2.5 Vol) | 1262.5 µl |

(Perform this precipitation in two tubes and split the 420 µl of DNA into 210 µl each, add 5 µl of 5 M NaCl, 37.5 µl of 2 M NaOAc pH 6.1, and 631.25 µl of 100% EtOH). Store at −20° C. for at least 30 min. Spin the DNA down at 4° C. at maximal speed for 30 min. and wash with 80% EtOH twice, then dissolve DNA in 70 µl RNase free water. Pool two tubes and end up with 140 µl.

Add the following reagents:

| | |
|---|---|
| RNase One 10 U/µl | 40 µl |
| 1st cDNA:RNA | 140 µl |
| 10X buffer | 20 µl |

Incubate at 37° C. for 15 min.

Add 5 µl of 40 µg/µl yeast tRNA to each sample for capturing.

F. Full Length 1$^{st}$ cDNA Capturing

Blocking the beads with yeast tRNA:

| Beads | 1 ml |
|---|---|
| Yeast tRNA 40 µg/µl | 5 µl |

Incubate on ice for 30 min with mixing, wash 3 times with 1 ml of 2 M NaCl, 50 mm EDTA, pH 8.0.

Resuspend the beads in 800 µl of 2 M NaCl, 50 mm EDTA, pH 8.0, add RNase I treated sample 200 µl, and incubate the reaction for 30 min at room temperature. Capture the beads using the magnetic stand, save the supernatant, and start following washes: 2 washes with 2 M NaCl, 50 mm EDTA, pH 8.0, 1 ml each time, 1 wash with 0.4% SDS, 50 µg/ml tRNA, 1 wash with 10 mm Tris-Cl pH 7.5, 0.2 mm EDTA, 10 mm NaCl, 20% glycerol, 1 wash with 50 µg/ml tRNA, 1 wash with 1$^{st}$ cDNA buffer.

G. Second Strand cDNA Synthesis

Resuspend the beads in:

| *5X first buffer | 8 µl |
|---|---|
| *0.1 mM DTT | 4 µl |
| *10 mm dNTP mix | 8 µl |
| *5X 2nd buffer | 60 µl |
| *E. coli Ligase 10 U/µl | 2 µl |
| *E. coli DNA polymerase 10 U/µl | 8 µl |
| *E. coli RNaseH 2 U/µl | 2 µl |
| P32 dCTP 10 µci/µl | 2 µl |
| Or water up to 300 µl | 208 µl |

Incubate at 16° C. for 2 hr with mixing the reaction in every 30 min. Add 4 µl of T4 DNA polymerase and incubate for additional 5 min at 16° C. Elute 2$^{nd}$ cDNA from the beads. Use a magnetic stand to separate the 2$^{nd}$ cDNA from the beads, then resuspend the beads in 200 µl of water, and then separate again, pool the samples (about 500 µl). Add 200 µl of water to the beads, then 200 µl of phenol:chloroform, vortex, and spin to separate the sample with phenol. Pool the DNA together (about 700 µl) and use phenol to clean the DNA again, DNA is then precipitated in 2 µg of glycogen and 0.5 vol of 7.5 M NH4OAc and 2 vol of 100% EtOH. Precipitate overnight. Spin down the pellet and wash with 70% EtOH, air-dry the pellet.

| DNA | 250 µl | DNA | 200 µl |
|---|---|---|---|
| 7.5 M NH4OAc | 125 µl | 7.5 M NH4OAc | 100 µl |
| 100% EtOH | 750 µl | 100% EtOH | 600 µl |
| glycogen 1 µg/µl | 2 µl | glycogen 1 µg/µl | 2 µl |

H. Sal I Adapter Ligation

Resuspend the pellet in 26 µl of water and use 1 µl for TAE gel.

Set up reaction as following:

| 2$^{nd}$ strand cDNA | 25 µl |
|---|---|
| *5X T4 DNA ligase buffer | 10 µl |
| *Sal I adapters | 10 µl |
| *T4 DNA ligase | 5 µl |

Mix gently, incubate the reaction at 16° C. overnight. Add 2 µl of ligase second day and incubate at room temperature for 2 hrs (optional).

Add 50 µl water to the reaction and use 100 µl of phenol to clean the DNA, 90 µl of the upper phase is transferred into a new tube and precipitate in:

| Glycogen 1 µg/µl | 2 µl |
|---|---|
| Upper phase DNA | 90 µl |
| 7.5 M NH4OAc | 50 µl |
| 100% EtOH | 300 µl |

Precipitate at −20° C. overnight. Spin down the pellet at 4° C. and wash in 70% EtOH, dry the pellet.

I. Not I Digestion

| 2$^{nd}$ cDNA | 41 µl |
|---|---|
| *Reaction 3 buffer | 5 µl |
| *Not I 15 u/µl | 4 µl |

Mix gently and incubate the reaction at 37° C. for 2 hr. Add 50 µl of water and 100 µl of phenol, vortex, and take 90 µl of the upper phase to a new tube, then add 50 µl of NH4OAc and 300 µl of EtOH. Precipitate overnight at −20° C.

Cloning, ligation, and transformation are performed per the Superscript cDNA synthesis kit.

EXAMPLE 3

This example describes cDNA sequencing and library subtraction.

Individual colonies can be picked and DNA prepared either by PCR with M13 forward primers and M13 reverse primers, or by plasmid isolation. cDNA clones can be sequenced using M13 reverse primers.

cDNA libraries are plated out on 22×22 cm² agar plate at density of about 3, 000 colonies per plate. The plates are incubated in a 37° C. incubator for 12-24 hours. Colonies are picked into 384-well plates by a robot colony picker, Q-bot (GENETIX Limited). These plates are incubated overnight at 37° C. Once sufficient colonies are picked, they are pinned onto 22×22 cm² nylon membranes using Q-bot. Each membrane holds 9, 216 or 36, 864 colonies. These membranes are placed onto an agar plate with an appropriate antibiotic. The plates are incubated at 37° C. overnight.

After colonies are recovered on the second day, these filters are placed on filter paper prewetted with denaturing solution for four minutes, then incubated on top of a boiling water bath for an additional four minutes. The filters are then placed on filter paper prewetted with neutralizing solution for four minutes. After excess solution is removed by placing the filters on dry filter papers for one minute, the colony side of the filters is placed into Proteinase K solution, incubated at 37° C. for 40-50 minutes. The filters are placed on dry filter papers to dry overnight. DNA is then cross-linked to nylon membrane by UV light treatment.

Colony hybridization is conducted as described by Sambrook, J., Fritsch, E. F. and Maniatis, T., (in Molecular Cloning: A laboratory Manual, 2nd Edition). The following probes can be used in colony hybridization:
1. First strand cDNA from the same tissue as the library was made from to remove the most redundant clones.
2. 48-192 most redundant cDNA clones from the same library based on previous sequencing data.
3. 192 most redundant cDNA clones in the entire maize sequence database.
4. A Sal-A20 oligo nucleotide (SEQ ID NO:376): TCG ACC CAC GCG TCC GAA AAA AAA AAA AAA AAA AAA, removes clones containing a poly A tail but no cDNA.
5. cDNA clones derived from rRNA.

The image of the autoradiography is scanned into computer and the signal intensity and cold colony addresses of each colony is analyzed. Re-arraying of cold-colonies from 384 well plates to 96 well plates is conducted using Q-bot.

EXAMPLE 4

This example describes identification of the gene from a computer homology search.

Gene identities can be determined by conducting BLAST (Basic Local Alignment Search Tool; Altschul, S. F., et al., (1993) J. Mol. Biol. 215:403-410) searches under default parameters for similarity to sequences contained in the BLAST "nr" database (comprising all non-redundant GenBank CDS translations, sequences derived from the 3-dimensional structure Brookhaven Protein Data Bank, the last major release of the SWISS-PROT protein sequence database, EMBL, and DDBJ databases). The cDNA sequences are analyzed for similarity to all publicly available DNA sequences contained in the "nr" database using the BLASTN algorithm. The DNA sequences are translated in all reading frames and compared for similarity to all publicly available protein sequences contained in the "nr" database using the BLASTX algorithm (Gish, W. and States, D. J. *Nature Genetics* 3:266-272 (1993)) provided by the NCBI. In some cases, the sequencing data from two or more clones containing overlapping segments of DNA are used to construct contiguous DNA sequences.

Sequence alignments and percent identity calculations can be performed using the Megalign program of the LASERGENE bioinformatics computing suite (DNASTAR Inc., Madison, Wis.). Multiple alignment of the sequences can be performed using the Clustal method of alignment (Higgins and Sharp (1989) *CABIOS.* 5:151-153) with the default parameters (GAP PENALTY=10, GAP LENGTH PENALTY=10). Default parameters for pairwise alignments using the Clustal method are KTUPLE 1, GAP PENALTY=3, WINDOW=5 and DIAGONALS SAVED=5.

EXAMPLE 5

This example describes expression of transgenes in monocot cells.

A transgene comprising a cDNA encoding the instant polypeptides in sense orientation with respect to the maize 27 kD zein promoter that is located 5' to the cDNA fragment, and the 10 kD zein 3' end that is located 3' to the cDNA fragment, can be constructed. The cDNA fragment of this gene may be generated by polymerase chain reaction (PCR) of the cDNA clone using appropriate oligonucleotide primers. Cloning sites (NcoI or SmaI) can be incorporated into the oligonucleotides to provide proper orientation of the DNA fragment when inserted into the digested vector pML103 as described below. Amplification is then performed in a standard PCR. The amplified DNA is then digested with restriction enzymes NcoI and SmaI and fractionated on an agarose gel. The appropriate band can be isolated from the gel and combined with a 4.9 kb NcoI-SmaI fragment of the plasmid pML103. Plasmid pML103 has been deposited under the terms of the Budapest Treaty at ATCC (American Type Culture Collection, 10801 University Blvd., Manassas, Va. 20110-2209), and bears accession number ATCC 97366. The DNA segment from pML103 contains a 1.05 kb SalI-NcoI promoter fragment of the maize 27 kD zein gene and a 0.96 kb SmaI-SalI fragment from the 3' end of the maize 10 kD zein gene in the vector pGem9Zf(+) (Promega). Vector and insert DNA can be ligated at 15° C. overnight, essentially as described (Maniatis). The ligated DNA may then be used to transform *E. coli* XL1-Blue (Epicurian Coli XL-1 Blue; Stratagene). Bacterial transformants can be screened by restriction enzyme digestion of plasmid DNA and limited nucleotide sequence analysis using the dideoxy chain termination method (Sequenase DNA Sequencing Kit; U.S. Biochemical). The resulting plasmid construct would comprise a transgene encoding, in the 5' to 3' direction, the maize 27 kD zein promoter, a cDNA fragment encoding the instant polypeptides, and the 10 kD zein 3' region.

The transgene described above can then be introduced into corn cells by the following procedure. Immature corn embryos can be dissected from developing caryopses derived from crosses of the inbred corn lines H99 and LH132. The embryos are isolated 10 to 11 days after pollination when they are 1.0 to 1.5 mm long. The embryos are then placed with the axis-side facing down and in contact with agarose-solidified N6 medium (Chu et al. (1975) *Sci. Sin. Peking* 18:659-668). The embryos are kept in the dark at 27° C. Friable embryogenic callus consisting of undifferentiated masses of cells with somatic proembryoids and embryoids borne on suspensor structures proliferates from the scutellum of these immature embryos. The embryogenic callus isolated from the primary explant can be cultured on N6 medium and sub-cultured on this medium every 2 to 3 weeks.

The plasmid, p35S/Ac (Hoechst Ag, Frankfurt, Germany) or equivalent may be used in transformation experiments in order to provide for a selectable marker. This plasmid contains the Pat gene (see European Patent Publication 0 242 236) which encodes phosphinothricin acetyl transferase (PAT). The enzyme PAT confers resistance to herbicidal glutamine synthetase inhibitors such as phosphinothricin. The pat gene in p35S/Ac is under the control of the 35S promoter from Cauliflower Mosaic Virus (Odell et al. (1985) *Nature* 313:810-812) and the 3' region of the nopaline synthase gene from the T-DNA of the Ti plasmid of *Agrobacterium tumefaciens*.

The particle bombardment method (Klein et al. (1987) *Nature* 327:70-73) may be used to transfer genes to the callus culture cells. According to this method, gold particles (1 μm in diameter) are coated with DNA using the following technique. Ten μg of plasmid DNAs are added to 50 μL of a suspension of gold particles (60 mg per mL). Calcium chloride (50 μL of a 2.5 M solution) and spermidine free base (20 μL of a 1.0 M solution) are added to the particles. The suspension is vortexed during the addition of these solutions. After 10 minutes, the tubes are briefly centrifuged (5 sec at 15,000 rpm) and the supernatant removed. The particles are resuspended in 200 μL of absolute ethanol, centrifuged again and the supernatant removed. The ethanol rinse is performed again and the particles resuspended in a final volume of 30 µL of ethanol. An aliquot (5 µL) of the DNA-coated gold particles can be placed in the center of a Kapton flying disc (Bio-Rad Labs). The particles are then accelerated into the corn tissue with a Biolistic PDS-1000/He (Bio-Rad Instruments, Hercules Calif.), using a helium pressure of 1000 psi, a gap distance of 0.5 cm and a flying distance of 1.0 cm.

For bombardment, the embryogenic tissue is placed on filter paper over agarose-solidified N6 medium. The tissue is arranged as a thin lawn and covered a circular area of about 5 cm in diameter. The petri dish containing the tissue can be placed in the chamber of the PDS-1000/He approximately 8 cm from the stopping screen. The air in the chamber is then evacuated to a vacuum of 28 inches of Hg. The macrocarrier is accelerated with a helium shock wave using a rupture membrane that bursts when the He pressure in the shock tube reaches 1000 psi.

Seven days after bombardment the tissue can be transferred to N6 medium that contains gluphosinate (2 mg per liter) and lacks casein or proline. The tissue continues to grow slowly on this medium. After an additional 2 weeks the tissue can be transferred to fresh N6 medium containing gluphosinate. After 6 weeks, areas of about 1 cm in diameter of actively growing callus can be identified on some of the plates containing the glufosinate-supplemented medium. These calli may continue to grow when sub-cultured on the selective medium.

Plants can be regenerated from the transgenic callus by first transferring clusters of tissue to N6 medium supplemented with 0.2 mg per liter of 2, 4-D. After two weeks the tissue can be transferred to regeneration medium (Fromm et al., (1990) *Bio/Technology* 8:833-839).

EXAMPLE 6

This example describes expression of transgenes in dicot cells.

A seed-specific expression cassette composed of the promoter and transcription terminator from the gene encoding the P subunit of the seed storage protein phaseolin from the bean *Phaseolus vulgaris* (Doyle et al., (1986) *J. Biol. Chem.* 261:9228-9238) can be used for expression of the instant polypeptides in transformed soybean. The phaseolin cassette includes about 500 nucleotides upstream (5') from the translation initiation codon and about 1650 nucleotides downstream (3') from the translation stop codon of phaseolin. Between the 5' and 3' regions are the unique restriction endonuclease sites NcoI (which includes the ATG translation initiation codon), SmaI, KpnI and XbaI. The entire cassette is flanked by Hind III sites.

The cDNA fragment of this gene may be generated by polymerase chain reaction (PCR) of the cDNA clone using appropriate oligonucleotide primers. Cloning sites can be incorporated into the oligonucleotides to provide proper orientation of the DNA fragment when inserted into the expression vector. Amplification is then performed as described above, and the isolated fragment is inserted into a pUC18 vector carrying the seed expression cassette.

Soybean embryos may then be transformed with the expression vector comprising sequences encoding the instant polypeptides. To induce somatic embryos, cotyledons, 3-5 mm in length dissected from surface sterilized, immature seeds of the soybean cultivar A2872, can be cultured in the light or dark at 26° C. on an appropriate agar medium for 6-10 weeks. Somatic embryos which produce secondary embryos are then excised and placed into a suitable liquid medium. After repeated selection for clusters of somatic embryos which multiplied as early, globular staged embryos, the suspensions are maintained as described below.

Soybean embryogenic suspension cultures can maintained in 35 mL liquid media on a rotary shaker, 150 rpm, at 26° C. with florescent lights on a 16:8 hour day/night schedule. Cultures are subcultured every two weeks by inoculating approximately 35 mg of tissue into 35 mL of liquid medium.

Soybean embryogenic suspension cultures may then be transformed by the method of particle gun bombardment (Klein et al., (1987) *Nature* (London) 327:70-73, U.S. Pat. No. 4,945,050). A DuPont Biolistic PDS1000/HE instrument (helium retrofit) can be used for these transformations.

A selectable marker gene which can be used to facilitate soybean transformation is a transgene composed of the 35S promoter from Cauliflower Mosaic Virus (Odell et al., (1985) *Nature* 313:810-812), the hygromycin phosphotransferase gene from plasmid pJR225 (from *E. coli*; Gritz et al., (1983) *Gene* 25:179-188) and the 3' region of the nopaline synthase gene from the T-DNA of the Ti plasmid of *Agrobacterium tumefaciens*. The seed expression cassette comprising the phaseolin 5' region, the fragment encoding the instant polypeptides and the phaseolin 3' region can be isolated as a restriction fragment. This fragment can then be inserted into a unique restriction site of the vector carrying the marker gene.

To 50 µL of a 60 mg/mL 1 □m gold particle suspension is added (in order): 5 µL DNA (1 µg/µL), 20 µl spermidine (0.1 M), and 50 µL $CaCl_2$ (2.5 M). The particle preparation is then agitated for three minutes, spun in a microfuge for 10 seconds and the supernatant removed. The DNA-coated particles are then washed once in 400 µL 70% ethanol and resuspended in 40 µL of anhydrous ethanol. The DNA/particle suspension can be sonicated three times for one second each. Five microliters of the DNA-coated gold particles are then loaded on each macro carrier disk.

Approximately 300-400 mg of a two-week-old suspension culture is placed in an empty 60×15 mm petri dish and the residual liquid removed from the tissue with a pipette. For each transformation experiment, approximately 5-10 plates of tissue are normally bombarded. Membrane rupture pressure is set at 1100 psi and the chamber is evacuated to a vacuum of 28 inches mercury. The tissue is placed approximately 3.5 inches away from the retaining screen and bombarded three times. Following bombardment, the tissue can be divided in half and placed back into liquid and cultured as described above.

Five to seven days post bombardment, the liquid media may be exchanged with fresh media, and eleven to twelve days post bombardment with fresh media containing 50 mg/mL hygromycin. This selective media can be refreshed weekly. Seven to eight weeks post bombardment, green, transformed tissue may be observed growing from untransformed, necrotic embryogenic clusters. Isolated green tissue is removed and inoculated into individual flasks to generate new, clonally propagated, transformed embryogenic suspension cultures. Each new line may be treated as an independent transformation event. These suspensions can then be subcultured and maintained as clusters of immature embryos or regenerated into whole plants by maturation and germination of individual somatic embryos.

EXAMPLE 7

This example describes expression of a transgene in microbial cells.

The cDNAs encoding the instant polypeptides can be inserted into the T7 E. coli expression vector pBT430. This vector is a derivative of pET-3a (Rosenberg et al. (1987) *Gene* 56:125-135) which employs the bacteriophage T7 RNA polymerase/T7 promoter system. Plasmid pBT430 was constructed by first destroying the EcoR I and Hind III sites in pET-3a at their original positions. An oligonucleotide adaptor containing EcoR I and Hind III sites was inserted at the BamH I site of pET-3a. This created pET-3aM with additional unique cloning sites for insertion of genes into the expression vector. Then, the NdeI site at the position of translation initiation was converted to an NcoI site using oligonucleotide-directed mutagenesis. The DNA sequence of pET-3aM in this region, 5'-CATATGG, was converted to 5'-CCCATGG in pBT430.

Plasmid DNA containing a cDNA may be appropriately digested to release a nucleic acid fragment encoding the protein. This fragment may then be purified on a 1% NuSieve GTG low melting agarose gel (FMC). Buffer and agarose contain 10 µg/ml ethidium bromide for visualization of the DNA fragment. The fragment can then be purified from the agarose gel by digestion with GELase (Epicentre Technologies) according to the manufacturer's instructions, ethanol precipitated, dried and resuspended in 20 µL of water. Appropriate oligonucleotide adapters may be ligated to the fragment using T4 DNA ligase (New England Biolabs, Beverly, Mass.). The fragment containing the ligated adapters can be purified from the excess adapters using low melting agarose as described above. The vector pBT430 is digested, dephosphorylated with alkaline phosphatase (NEB) and deproteinized with phenol/chloroform as described above. The prepared vector pBT430 and fragment can then be ligated at 16° C. for 15 hours followed by transformation into DH5 electrocompetent cells (GIBCO BRL). Transformants can be selected on agar plates containing LB media and 100 µg/mL ampicillin. Transformants containing the gene encoding the instant polypeptides are then screened for the correct orientation with respect to the T7 promoter by restriction enzyme analysis.

For high level expression, a plasmid clone with the cDNA insert in the correct orientation relative to the T7 promoter can be transformed into E. coli strain BL21(DE3) (Studier et al. (1986) *J. Mol. Biol.* 189:113-130). Cultures are grown in LB medium containing ampicillin (100 mg/L) at 25° C. At an optical density at 600 nm of approximately 1, IPTG (isopropylthio-β-galactoside, the inducer) can be added to a final concentration of 0.4 mM and incubation can be continued for 3 h at 25°. Cells are then harvested by centrifugation and re-suspended in 50 µL of 50 mM Tris-HCl at pH 8.0 containing 0.1 mM DTT and 0.2 mM phenyl methylsulfonyl fluoride. A small amount of 1 mm glass beads can be added and the mixture sonicated 3 times for about 5 seconds each time with a microprobe sonicator. The mixture is centrifuged and the protein concentration of the supernatant determined. One microgram of protein from the soluble fraction of the culture can be separated by SDS-polyacrylamide gel electrophoresis. Gels can be observed for protein bands migrating at the expected molecular weight.

The above examples are provided to illustrate the invention but not to limit its scope. Other variants of the invention will be readily apparent to one of ordinary skill in the art and are encompassed by the appended claims. All publications, patents, patent applications, and computer programs cited herein are hereby incorporated by reference.

SEQUENCE LISTING (376 sequences)

SEQ ID NO: 1 - DNA, 665 bp, Oryza sativa
  unsure (41): n is a, c, g or t
  unsure (44): n is a, c, g or t
  unsure (502): n is a, c, g or t
  unsure (522): n is a, c, g or t
  unsure (597): n is a, c, g or t
gttctaactcggagccggcggcgagggcggtggcggaggangtngccccggtggggagggatgaggcagacgggggtgacgctgcggtacatgatggagttcggggcgcgccccacggagaggaacctgctgcggtcggcgcagttcctgcgcagggagctccccatccgcatcgcccgccgcgcgctcgacctcgactccctccccttcggcctctccaccaagcccgccatcctcaaggtgagagattggtatttggactcattccgcgacttacggtgcttcccggaggtgaggaaccgggatgatgagcttgcattcaccgagatgatcaagatgattcgagtgcggcacaacaatgtggtgcccaccatggcgttgggtgtgcggcagctgaagaaagacctgggtggcacaaaggcctttccccctggcattgatgagatccatcagttcctcgaccgcttctacatgtcaaggattgggatccgcatgctgatanggaacatttctttgcatganctgatcagaactggtgttattggactcataacaaaagatatcccatgctggtggccacatcactgaagatcacgncattgcataaggaatatgatagccctgattaaatatatgagaccaattcaattcatagtaacactcta

SEQ ID NO: 2 - protein, 166 aa, Oryza sativa
  UNSURE (13): Xaa can be any naturally occurring amino acid
SNSEPAARAVAEXVARWGGMRQTGVTLRYMMEFGARPTERNLLRSAQFLRRELPIRIARRALDLDSLPFGLSTKPAILKVRDWYLDSFRDLRCFPEVRNRDDELAFTEMIKMIRVRHNNVVPTMALGVRQLKKDLGGTKAFPPGIDEIHQFLDRFYMSRIGIRMLI

SEQ ID NO: 3 - DNA, 1407 bp, Oryza sativa
gcacgaggttctaactcggagccggcggcgagggcggtggcggaggaggtggcgcggtggggagggatgaggcagacgggggtgacgctgcggtacatgatggagttcggggcgcgccccacggagaggaacctgctgcggtcggcgcagttcctgcgcagggagctccccatccgcatcgcccgccgcgcgctcgacctcgactccctccccttcggcctctccaccaagcccgccatcctcaaggtgagagattggtatttggactcattccgcgacttacggtgcttcccggaggtgaggaaccgggatgatgagcttgcattcaccgagatgatcaagatgattcgagtgcggcacaacaatgtggtgcccaccatggcgttgggtgtgcggcagctgaagaaagacctgggtggcacaaaggcctttccccctggcattgatgagatccatcagttcctcgaccgcttctacatgtcaaggattgggatccgcatgctgatagggcagcatgttgctttgcatgagcctgatccagaacctggtgttattggactcataagcaaaagattatcccccatgctggtggctcaacatgctactgaagatgcacgtgctatttgcatgagggaatatggatcagcccctgatgtgaacatatatggagacccagatttcacatttccatatgttaaactacatctacaactgatgatgtttgaattggtgaagaattccctccgtgcagtacaggaacgatatatgaactctgataagcatgcgcctcctgttagaatcatagtcgctgatggagcagaggacgtaacaatcaagattagtgatgaaggtggtggaatacccagaagtggtctctcgagaattttcacatatctctacagcacagcagaaaacccacctgatctggatggccgtaacgaaggagtgaccatggccgggtacggctatgggatcccgattagccgtctttatgctcgatattttggcggggacctgcagatcatttctatggaaggatatggaaccgatgcttacctccacctatcacggctaggagattcggaggagcccttgcattaggagatctggaggaggaaaccctttgcctcagttctgataccactgctgtaattaggatgctattgcttttaccattgctgtgctggtatgcaaatacatagttcccaaggccagccagctctatgtgcttccagtttgctggagcgtgatcataattcagatttcagaatcccctctggttcacattgccattagaactcgttatccctcgccctcggtggctgcctgaaaaatgtgatgtacagttgtccgttttcggagttctgcatggggagtatcttttttttcaaaaaaaaaaaaaaaaaa

SEQ ID NO: 4 - protein, 364 aa, Oryza sativa
GSNSEPAARAVAEEVARWGGMRQTGVTLRYMMEFGARPTERNLLRSAQFLRRELPIRIARRALDLDSLPFGLSTKPAILKVRDWYLDSFRDLRCFPEVRNRDDELAFTEMIKMIRVRHNNVVPTMALGVRQLKKDLGGTKAFPPGIDEIHQFLDRFYMSRIGIRMLIGQHVALHEPDPEPGVIGLISKRLSPMLVAQHATEDARAICMREYGSAPDVNIYGDPDFTFPYVKLHLQLMMFELVKNSLRAVQERYMNSDKHAPPVRIIVADGAEDVTIKISDEGGGIPRSGLSRIFTYLYSTAENPPDLDGRNEGVTMAGYGYGIPISRLYARYFGGDLQIISMEGYGTDAYLHLSRLGDSEEPLH

SEQ ID NO: 5 - DNA, 503 bp, Oryza sativa
  unsure (496): n is a, c, g or t
  unsure (502): n is a, c, g or t
gcaggttagtgatgaaggtggtggaataccaaggagcggccttccaagaattttcacatatctatatagcactgcaaagaatccacctgatatggattgccctagtgaaggagtaactatggctggatatggctatggtcttccaatcagtcgcctgtatgctcgatattttggtggtgacctgcaaatcatctctatggaaggatacggcaccgatgcttacctgcacttgtcacggttgggagattcggaggagcccttgccttgaaggcttccctgtcctgataccatctctgtaattaattaggttgctcttgtctcttgtaattcctgggctggtttggaatattgttttcaagtgccagccacctatagctgttaaccttctacagtagttgccacggtttcatcacttcagctttgcaacagcatgagcacaagtctcctctctctctttctctctctctctactccgccttgtaacgaaatgtagaantcctcng

SEQ ID NO: 6 - protein, 88 aa, Oryza sativa
QVSDEGGGIPRSGLPRIFTYLYSTAKNPPDMDCPSEGVTMAGYGYGLPISRLYARYFGGDLQIISMEGYGTDAYLHLSRLGDSEEPLP

SEQ ID NO: 7 - DNA, 616 bp, Oryza sativa
  unsure (442): n is a, c, g or t
  unsure (470): n is a, c, g or t
  unsure (611): n is a, c, g or t
gcagacgggggtgagcctgcgctacatgatggagttcgggtcgcgccccacggagcggaacctgctgctctccgcgcagttcctgcagaaggagctcccaatccggatcgcgcgccgcgcgctcgagctcgagtccctccccttcggcctctcccgcaagcccgccatcctcaaggtgcgggattggtacttggactctttccgcgacatcagatactttccagaagtgaggaataggaacgacgagctcgcttttacgcagatgatcaagatgatcaaagtacgccacaataatgtggttccaacgatggcactgggagttcaacagctcaagaacgagcagtatcgcacaaggaagatccccactgcatttgacgagatccacgagtttcttgacagattctacatgtcaaggattgggatccgcatgcttatagggcancatgtggctttgcatgatcctgacccangagcctggcgtcataggcctcattaatacagaattgtcccctatacaggtggctcaagctgccagtgaaagatgcccgttctatttgttttgagggaatatggatcagctcctggagattgacatcttatggagacccaanctttt

SEQ ID NO: 8 - protein, 193 aa, Oryza sativa
  UNSURE (147): Xaa can be any naturally occurring amino acid
QTGVSLRYMMEFGSRPTERNLLLSAQFLQKELPIRIARRALELESLPFGLSRKPAILKVRDWYLDSFRDIRYFPEVRNRNDELAFTQMIKMIKVRHNNVVPTMALGVQQLKNEQYRTRKIPTAFDEIHEFLDRFYMSRIGIRMLIGXHVALHDPDPEPGVIGLINTELSPIQVAQAASEDARLFVLREYGSAP

SEQ ID NO: 9 - DNA, 1481 bp, Oryza sativa
ccaaatctcgccgccggtgaaggaggtagaagtggaggtggaggtggggggaggatggcgtcggagccggtggcgagggcggtggcggaggaggtggggaggtgggggagcatgaagcagacgggggtgagcctgcgctacatgatggagttcgggtcgcgccccacggagcggaacctgctgctctccgcgcagttcctgcagaaggagctcccaatccggatcgcgcgccgcgcgctcgagctcgagtccctccccttcggcctctcccgcaagcccgccatcctcaaggtgcgggattggtacttggactctttccgcgacatcagatactttccagaagtgaggaataggaacgacgagctcgcttttacgcagatgatcaagatgatcaaagtacgccacaataatgtggttccaacgatggcactgggagttcaacagctcaagaacgagcagtatcgcacaaggaagatccccactgcatttgacgagatccacgagtttcttgacagattctacatgtcaaggattgggatccgcatgcttatagggcagcatgtggctttgcatgatcctgacccagagcctggcgtcataggcctcattaatacagaattgtcccctatacaggtggctcaagctgccagtgaagatgcccgttctatttgtttgagggaatatggatcagctcctgagattgacatctatggagacccaacttttacatttccatatgtttcatcacatctacatctcatgctatttgaattggtgaagaactccttgcgtgcagtacaggaacgatatatgaattccgataaagatgttcctccagttagaattatcgttgctgatggggcagaggatgtaactatcaaggttagtgatgaaggtggtggaataccaaggagcggccttccaagaattttcacatatctatatagcactgcaaagaatccacctgatatggattgccctagtgaaggagtaactatggctggatatggctatggtcttccaatcagtcgcctgtatgctcgatattttggtggtgacctgcaaatcatctctatggaaggatacggcaccgatgcttacctgcacttgtcacggttgggagattcggaggagcccttgccttgaaggcttccctgtcctgataccatctctgtaattaattaggttgctcttgtctcttgtaattcctgggctggtttggaatattgttttcaagtgccagccacctatagctgttaaccttctacagtagttgccacggtttcatcacttcagctttgcagcagcatgagcacaagtctcctctctctctttctctctctctctactctgccttgtagcgaaatgtagaattcttctgccacgcacatggcattgttcatacttctcgtacttgttgagcttcatggcttggtgcagattgtactttgatagttatcagtagtaagctaacttcatca

SEQ ID NO: 10 - protein, 363 aa, Oryza sativa
MASEPVARAVAEEVGRWGSMKQTGVSLRYMMEFGSRPTERNLLLSAQFLQKELPIRIARRALELESLPFGLSRKPAILKVRDWYLDSFRDIRYFPEVRNRNDELAFTQMIKMIKVRHNNVVPTMALGVQQLKNEQYRTRKIPTAFDEIHEFLDRFYMSRIGIRMLIGQHVALHDPDPEPGVIGLINTELSPIQVAQAASEDARSICLREYGSAPEIDIYGDPTFTFPYVSSHLHLMLFELVKNSLRAVQERYMNSDKDVPPVRIIVADGAEDVTIKVSDEGGGIPRSGLPRIFTYLYSTAKNPPDMDCPSEGVTMAGYGYGLPISRLYARYFGGDLQIISMEGYGTDAYLHLSRLGDSEEPLP

SEQ ID NO: 11 - DNA, 503 bp, Glycine max
gttgcatgctggtgttggtgttggtgtcccaattcactctcaaatttcagggttcttaagaactactaggaccttgccaccaccatggctgccaaaaaggcatgtgagacattctcaaagtcattgattgaggaagtgaatagatggggttgcttgaagcagacaggggtgagtctcaggtacatgatggaattcgggtccaaacccactaacaagaatttgctgatctctgcccagtttcttcacaaggaacttgccatcagaattgccagaagggccgttgaacttgagaatcttccctatggtttgtctcaaaaacctgctgttctgaaggttagggattggtatgtggattctttccgtgatgtcagagccttccctgacatcaagaatgtgaatgatgaaagagagttcactgaaatgattaagggcatcaaagtgaggcacaacaatgtggtacccacaatgggcatggggagttcagcaattgaagaaaggatggg

SEQ ID NO: 12 - protein, 139 aa, Glycine max
MAAKKACETFSKSLIEEVNRWGCLKQTGVSLRYMMEFGSKPTNKNLLISAQFLHKELAIRIARRAVELENLPYGLSQKPAVLKVRDWYVDSFRDVRAFPDIKNVNDEREFTEMIKGIKVRHNNVVPTMGMGSSAIEERM

SEQ ID NO: 13 - DNA, 1382 bp, Glycine max
gcacgaggttgcatgctggtgttggtgttggtgtcccaattcactctcaaatttcagggttcttagaactactaggaccttgccaccaccatggctgccaaaaaggcatgtgagacattctcaaagtcattgattgaggaagtgaatagatggggttgcttgaagcagacaggggtgagtctcaggtacatgatggaattcgggtccaaacccactaacaagaatttgctgatctctgcccagtttcttcacaaggaacttgccatcagaattgccagaagggccgttgaacttgagaatcttccctatggtttgtctcaaaaacctgctgttctgaaggttagggattggtatgtggattctttccgtgatgtcagagccttccctgacatcaagaatgtgaatgatgaaagagagttcactgaaatgattaaggccatcaaagtgaggcacaacaatgtggtacccacaatggccatgggagttcagcaattgaagaaaggtatggatccaaagattgtttatgaagatcttgttgagattcatcagttccttgaccgcttctacatgtcaagaattggaatccgtatgcttatcgggcagcatgttgagttgcacaatcccaatcctcctccccacgtcgtgggttacatacacacgaaaatgtctcctgtggaggtggcgaggaatgccagtgaagatgcacgttctatatgttgtcgtgaatatggaagtgcccctgatgtccatatttatggagatcctaattttacttttccgtatgttccagctcacttgcatcttatggtatttgagttggttaagaactcactgcgtgctgtacaagagcgttttatgaattccgataaagttgcacctcccattagaataatagttgctgatggaatagaggatgttaccataaaggtctcagatgagggaggtggaattgcaagaagtggtttgcctaaaatttttacatatctatatagtactgccagaaacccattggatgagcattcggatcttggaataggtgataatgtgacaatggctggatatggatatggtcttcctattagtcgtctatatgctcggtattttggaggtgatcttcaaataatctctatggaaggatatggcactgatgcatatctccatttgtctcgtttgggagattcacaagaacctttgccttgaaagtacttttcagtcagttaccgtaagtaactcagtaacattgtgctagggaaaacaccattgctagcataaaaaacaaaaagtactatttgctgtcaattttttacattctaataatttgacagatttcctgtaaatatgtggtacaaaagattgtgcaaaaaaaaaaaaaaaaaaaaaaa

SEQ ID NO: 14 - protein, 369 aa, Glycine max
MAAKKACETFSKSLIEEVNRWGCLKQTGVSLRYMMEFGSKPTNKNLLISAQFLHKELAIRIARRAVELENLPYGLSQKPAVLKVRDWYVDSFRDVRAFPDIKNVNDEREFTEMIKAIKVRHNNVVPTMAMGVQQLKKGMDPKIVYEDLVEIHQFLDRFYMSRIGIRMLIGQHVELHNPNPPPHVVGYIHTKMSPVEVARNASEDARSICCREYGSAPDVHIYGDPNFTFPYVPAHLHLMVFELVKNSLRAVQERFMNSDKVAPPIRIIVADGIEDVTIKVSDEGGGIARSGLPKIFTYLYSTARNPLDEHSDLGIGDNVTMAGYGYGLPISRLYARYFGGDLQIISMEGYGTDAYLHLSRLGDSQEPLP

SEQ ID NO: 15 - DNA, 543 bp, Glycine max
  unsure (346): n is a, c, g or t
  unsure (422): n is a, c, g or t
  unsure (522): n is a, c, g or t
aggtctcagatgagggaggtggaattgcaagaagtgggttgcctaaaatttttacatatctatatagtactgcgagaaacccattggatgagcattcggatcttggaataggtgataatgtgacaatggctggatatggatatggtcttcctattagtcgtctatatgctcggtattttggaggtgatcttcaaataatctctatggaaggatatggtgagtaggctattacttgttttccccttcatttacaacatttttctgatagatatccttccactttttgtaattctacctactttagcacttaaagagttacaactctttgtatatcttctccatttanaatttagggatttggagatatgggacctaattgcaccttgatatcatgaaactggtgtcaaacttaatttcctggntacaattcaaggccctgaagatcgattttggaccttcacaataaatggttaacggccttcaattggggtaacaaagtgaataataataatttcccccaanggtgtaaaggggtgtttggtc

SEQ ID NO: 16 - protein, 73 aa, Glycine max
VSDEGGGIARSGLPKIFTYLYSTARNPLDEHSDLGIGDNVTMAGYGYGLPISRLYARYFGGDLQIISMEGYGE

SEQ ID NO: 17 - DNA, 546 bp, Glycine max
  unsure (8): n is a, c, g or t
  unsure (24): n is a, c, g or t
  unsure (37): n is a, c, g or t
  unsure (44): n is a, c, g or t
  unsure (53): n is a, c, g or t
tggattantagtttcttgatggantaggaggatgttnccataanggtctcagntgagggagttggaattgcaggaagtgggttgcctaaaatttttacatatctatatagtactgcgagaaacccattggatgagcattcggatcttggaataggtgataatgtgacaatggctggatatggatatggtcttcctattagtcgtctatatgctcggtattttggaggtgatcttcaaataatctctatggaaggatatggcactgatgcatatctccatttgtctcgtttgggagattcacaagaacctttgccctgaaagtacttttcagtcagagttaccttaagtaactcactaacattgtgctaaggaaaacacttgttagaataaaaaagtactatttgctgtcaatttttacattctaataatttgacagatttcctgtaaatatgtggtacataagattgtgcatggtgatgccccccttctttgccttcagatccagctttgggaatttgtcctttttatcttctgaaaaaaaaaaaa

SEQ ID NO: 18 - protein, 96 aa, Glycine max
  UNSURE (4): Xaa can be any naturally occurring amino acid
  UNSURE (6): Xaa can be any naturally occurring amino acid
  UNSURE (9): Xaa can be any naturally occurring amino acid
EDVXIXVSXEGVGIAGSGLPKIFTYLYSTARNPLDEHSDLGIGDNVTMAGYGYGLPISRLYARYFGGDLQIISMEGYGTDAYLHLSRLGDSQEPLP

SEQ ID NO: 19 - DNA, 529 bp, Glycine max
  unsure (515): n is a, c, g or t
  unsure (527): n is a, c, g or t
gttaggtctcagatgagggaggtggaataccaaggagtggtcttccaaaaatatttacatatctctacagtacagccagaaatgcatcgtgggatgaaaatgaaccttctgatcttggaacaaccgataatataagtgtaaaaatggctggaaatggttatggacttcctatttgccgcttgtatgctaggtattttggtggcgatcttcaagtaatctctatggaaggatatggtgttggctaatggtactgtgttgtttgagatttaatggagtttgaagaagatggagaagggggttcaaaaatttgtgataatccaaaaattatttctaagtttaaatgaaaaatcttaagttcagatttacctaaacctacattaaaaaaaatgacaaatttaaattttgtaagaagaaaaattagatacaatatattacagaaacagatttcaaatattttgatatttatatggatgaaaaacttaatttaatgattttttttaagaaaggtggttccnttgggaggaaanga

SEQ ID NO: 20 - protein, 77 aa, Glycine max
VSDEGGGIPRSGLPKIFTYLYSTARNASWDENEPSDLGTTDNISVKMAGNGYGLPICRLYARYFGGDLQVISMEGYG

SEQ ID NO: 21 - DNA, 1114 bp, Triticum aestivum
  unsure (794): n is a, c, g or t
  unsure (943): n is a, c, g or t
  unsure (948): n is a, c, g or t
  unsure (958): n is a, c, g or t
  unsure (999): n is a, c, g or t
  unsure (1003)..(1004): n is a, c, g or t
  unsure (1037): n is a, c, g or t
  unsure (1073): n is a, c, g or t
  unsure (1085): n is a, c, g or t
  unsure (1093): n is a, c, g or t
  unsure (1100): n is a, c, g or t
  unsure (1104): n is a, c, g or t
cttctctcccccctgatgccgccttaattagccgcctgccccccctaatcctcctgtttgcacggcggttacccggctccgcgtcggcgagcggtggcggcggcgggcggcggagggatgatggcgtcggagccggtggcgcgggccgtggcggaggaggtggggcggtggggcagcatgaagcagacgggggtgagcctgcggtacatgatggagttcgggtccgtccccacggaccgcaacctgctgctctccgcgcagttcctgcacaaggagctccccatccgcatcgcccgccgcgcgctcgagctcgagtctcttcccttcggcctctccgccaagcccgccatcctcaaggtgagggactggtacttggactcgttccgcgacatccggtattttccagaagtgaggaatcgggacgacgagcttgctttcacacagatgattaagatgatcaaagtgcggcacaataacgtggtaccgactatggtcttgggagtgcaacagctgaaaaacgaacagttcagctcaaggaagcttcccccaggattcgacgagatccacgggttcctcgatcgattttacatgtcaaggattggtattcgcatgctcatagggcagcatgtggctctgcatgaacctgaaccacagcctggcgtcataggcctcatcaatacaaaattgtcccccatacaggtagctcaaattgctagtgaggatgcccgttccatttgtatgagggaatacggatcagctcctgacatcaacatttatggaggatcaaaatttancatttccatatgtcacatcgcatcttcatctcatgctgtttgaactggtgaaaaattcccttcgtgcagtacaggaaagatatatgaattctgataaagatgttcctcctggcagaattatagttgctgatggacaataggatgttacnattanggcagtgatnaaggcggtggatacggggaatggctccctagatttcaatancttnnagacgcaaggatctactgatatgggggcctaanaaggatggctaggtggtatggtttggcctcaattancccttaccgganatccgggnggctaantaanccatggggat

SEQ ID NO: 22 - protein, 290 aa, Triticum aestivum
  UNSURE (272): Xaa can be any naturally occurring amino acid
MMASEPVARAVAEEVGRWGSMKQTGVSLRYMMEFGSVPTDRNLLLSAQFLHKELPIRIARRALELESLPFGLSAKPAILKVRDWYLDSFRDIRYFPEVRNRDDELAFTQMIKMIKVRHNNVVPTMVLGVQQLKNEQFSSRKLPPGFDEIHGFLDRFYMSRIGIRMLIGQHVALHEPEPQPGVIGLINTKLSPIQVAQIASEDARSICMREYGSAPDINIYGDQNLTFPYVTSHLHLMLFELVKNSLRAVQERYMNSDKDVPPGRIIVADGQXDVTIKVSDEGGGIRGMAP

SEQ ID NO: 23 - DNA, 1424 bp, Triticum aestivum
gcacgagcttctctcccccctgatgccgccttaattagccgcctgccccccctaatcctcctgtttgcacggcggttacccggctccgcgtcggcgagcggtggcggcggcgggcggcggagggatgatggcgtcggagccggtggcgcgggccgtggcggaggaggtggggcggtggggcagcatgaagcagacgggggtgagcctgcggtacatgatggagttcgggtccgtccccacggaccgcaacctgctgctctcggcccagttcctgcaaaaggagctccccatccgcatcgcccgccgcgcgctcgagctcgagtccctccccttcggcctctccgccaagcccgccatcctcaaggtgagggactggtacttggactcgttccgcgacatccgatatttcccagaagtgaggaatcgggacgacgagcttgctttcacgcagatgattaagatgatcaaagtgcggcacaataacgtggtaccgactatggctttgggagtgcaacagctgaaaaacgaacagttcagctcaaggaagcttcccccaggattcgacgagatccacgggttcctcgatcgattttacatgtcaaggattggtattcgcatgctcatagggcagcatgtggctctgcatgaacctgaaccacagcctggcgtcataggcctcatcaatacaaaattgtcccccatacaggtagctcaaattgctagtgaggatgcccgttccatttgtatgagggaatacggatcagctcctgacatcaacatttatggagatcaaaatttaacatttccatatgtcacatcgcatcttcatctcatgctgtttgaactggtgaaaaattcccttcgtgcagtacaggaaagatatatgaattctgataaagatgttcctcctgtcagaattatagttgctgatggaacagaggatgttactattaaggtcagtgatgaaggcggtggaatacggagaagtgggctccctagaattttcacatatctttacagcactgcaaagaatctacctgatatggagggccctagtgaaggagtgactatggctggatatggttttggacttccagttagtcgcctttatgcgcgatatttcggtggcgacctacaaatcatatccatggagggatacggcaccgacgcttacctccacttgtcacgactgggagactcggaggagccattgccttagtgaccccttctatcctgatacagtttctgtaattaggttgctcttgttatattgtaatccttgttctggtttgcaaatattgtttcaagggccagccatatatagctgttaaacctgtatcttctagctataattatctcattgtttctgcttttctgcctgtgttgcataatttggcaaaaaaaaaaaaaaaaaaaaaaaaaaa

SEQ ID NO: 24 - protein, 364 aa, Triticum aestivum
MMASEPVARAVAEEVGRWGSMKQTGVSLRYMMEFGSVPTDRNLLLSAQFLQKELPIRIARRALELESLPFGLSAKPAILKVRDWYLDSFRDIRYFPEVRNRDDELAFTQMIKMIKVRHNNVVPTMALGVQQLKNEQFSSRKLPPGFDEIHGFLDRFYMSRIGIRMLIGQHVALHEPEPQPGVIGLINTKLSPIQVAQIASEDARSICMREYGSAPDINIYGDQNLTFPYVTSHLHLMLFELVKNSLRAVQERYMNSDKDVPPVRIIVADGTEDVTIKVSDEGGGIRRSGLPRIFTYLYSTAKNLPDMEGPSEGVTMAGYGFGLPVSRLYARYFGGDLQIISMEGYGTDAYLHLSRLGDSEEPLP

SEQ ID NO: 25 - DNA, 523 bp, Zea mays
  unsure (433): n is a, c, g or t
  unsure (458): n is a, c, g or t
  unsure (496): n is a, c, g or t
  unsure (502): n is a, c, g or t
  unsure (516): n is a, c, g or t
cacatgtgcatgttgtttacaggccaggctttcaggaagttgatactccaagaaggcgagaaatttgtccttgtgttatttgatactccatacaaccaggccgcatatggtattgtggataaactagggagtctggttgttaggatagttttcttgccatttgaagagagttcatatgccacttttgcccgattggcaggagagagtccccgaaatatatccaatattgaagactctttgcttggtgcgcttaagcttattatgctaataggtttggtgatcatttcatttggtccaagttattcatatacccttctaaaattactctatggggaaagacacagtgatggagaggctccaagttattcttcgttactattgtttatatatcatcaagtttagcaatgaatggcacatctgaaagcctttcttnaagccggttgcaaatgaaaaccaancttaagcaatcaaatgatatgttgcttcctgttccccngtgganttacaacaattccnaaatgtt

SEQ ID NO: 26 - protein, 115 aa, Zea mays
HMCMLFTGQAFRKLILQEGEKFVLVLFDTPYNQAAYGIVDKLGSLVVRIVFLPFEESSYATFARLAGESPRNISNIEDSLLGALKLIMLIGLVIISFGPSYSYTLLKLLYGERHS

SEQ ID NO: 27 - DNA, 1102 bp, Zea mays
cacatgtgcatgttgtttacaggccaggctttcaggaagttgatactccaagaaggcgagaaatttgtccttgtgttatttgatactccatacaaccaggccgcatatggtattgtggataaactagggagtctggttgttaggatagttttcttgccatttgaagagagttcatatgccacttttgcccgattggcaggagagagtccccgaaatatatccaatattgaagactctttgcttggtgcgcttaagcttattatgctaataggtttggtgatcatttcatttggtccaagttattcatatacccttctaaaattactctatggggaaagacacagtgatggagaggctccagttattcttcgttactattgtttatatatcatcagtttagcaatgaatggcacatctgaagcctttcttcatgctgttgcaaatgaaaaccagcttaagcagtcaaatgatatgttgcttctgttctcggtgatttacatcattctaaatgttgttcttattaaatcttctggagctgttgggttaattgctgctaatgccattaatatgttgcttcgaatatcatattctgcagtatttataaaagactatttcaagggctcattctctttccggcgctgtgtgcctgcgggctggggcattttactcatttctggtctgaccactgttttctctgagagggttttcttgaacaaaacgaggttcaagcagactgttcccattcacatagcgattggcatcatgtgcttgagcatcgcgttacttgagatataccgtggcgaaaagcagttcttgatgcaaataatcagaactttgaagcataatgacaaaagccagtgatttgaagacacagcgcatttcatagcgtattctctctggaacgcctgatgaaagagagctggtagtatagtgggtgggtaatttggtgtgtatgcaggagatcgggagttaacagaagaggggggattaatcggtcagatagataaatcggttgcgtatgggaattgctggatttcttgttgacccaatatttatattacaggtttattgagctagtgattcaataatttataattaaaaa

SEQ ID NO: 28 - protein, 286 aa, Zea mays
HMCMLFTGQAFRKLILQEGEKFVLVLFDTPYNQAAYGIVDKLGSLVVRIVFLPFEESSYATFARLAGESPRNISNIEDSLLGALKLIMLIGLVIISFGPSYSYTLLKLLYGERHSDGEAPVILRYYCLYIISLAMNGTSEAFLHAVANENQLKQSNDMLLLFSVIYIILNVVLIKSSGAVGLIAANAINMLLRISYSAVFIKDYFKGSFSFRRCVPAGWGILLISGLTTVFSERVFLNKTRFKQTVPIHIAIGIMCLSIALLEIYRGEKQFLMQIIRTLKHNDKSQ

SEQ ID NO: 29 - DNA, 547 bp, Oryza sativa
cttacacgttactattgtttctacgtcatatgcttagcaatgaatggcacatctgaagctttccttcatgctgttgcaaatgaagacaagcttaagcagtcaaatgatatgttgctcctgttctcggcaatttacattgtgctaaatgttgtcctgattaaatctgctggtgcagttgggttgattgctgcaaattccatcaatatgctgctgcgaatcacatattcagcggcattcattaaagactatttcaagggctcattctctttccgccactgcttgccggcaggctggggtgtgttgctcatttctggcctgaccacaagctttctctgaaaggatgtttctgaataagaaacaggttcaagcaaacccttcccattcacatggggataggcataatgtgcctgggtttctcaacactcgagatataccgtggtgaaaagcagttcttgacgagtataatcaagatcattgaagagccgcgacaaacttgcatgagtctaacaacattcaaggttttgccaagtggttttagcattcgcct

SEQ ID NO: 30 - protein, 111 aa, Oryza sativa
LTRYYCFYVICLAMNGTSEAFLHAVANEDKLKQSNDMLLLFSAIYIVLNVVLIKSAGAVGLIAANSINMLLRITYSAAFIKDYFKGSFSFRHCLPAGWGVLLISGLTTSFL

SEQ ID NO: 31 - DNA, 814 bp, Oryza sativa
gcacgagcttacacgttactattgtttctacgtcatatgcttagcaatgaatggcacatctgaagctttccttcatgctgttgcaaatgaagacaagcttaagcagtcaaatgatatgttgctcctgttctcggcaatttacattgtgctaaatgttgtcctgattaaatctgctggtgcagttgggttgattgctgcaaattccatcaatatgctgctgcgaatcacatattcagcggcattcattaaagactatttcaagggctcattctctttccgccactgcttgccggcaggctggggtgtgttgctcatttctggcctgaccacagctttctctgaaaggatgtttctgaatagaaacaggttcaagcagacccttcccattcacatggcgataggcataatgtgcctgggtttctcatcactcgagatataccgtggtgaaaagcagttcttgacgagtataatcagatcattgaagagccgcgacaaacttgcatgagtctaacaacattcagggttttgcgagtgtttttagcattcgcctgataaccgcattttcagaaagaaaacatatacgatgccgtaaatataattgtacattgcatgggttgacgacagaagataattatgccaagcggctggaggacttcactgaacatggatcaaactggtcgcgttctctactggagtcgggttaatggtgtgtgcagcagaacaactgttcactaaacggcaacagaaagcatagatcagtggcttatataggcaatttattatcttattctgtaaaaaaaaaaaaaaaaaaaaa

SEQ ID NO: 32 - protein, 165 aa, Oryza sativa
LTRYYCFYVICLAMNGTSEAFLHAVANEDKLKQSNDMLLLFSAIYIVLNVVLIKSAGAVGLIAANSINMLLRITYSAAFIKDYFKGSFSFRHCLPAGWGVLLISGLTTAFSERMFLNRNRFKQTLPIHMAIGIMCLGFSSLEIYRGEKQFLTSIIRSLKSRDKLA

SEQ ID NO: 33 - DNA, 708 bp, Helianthus tuberosus
  unsure (566): n is a, c, g or t
  unsure (570): n is a, c, g or t
  unsure (607): n is a, c, g or t
  unsure (627): n is a, c, g or t
  unsure (632): n is a, c, g or t
  unsure (643): n is a, c, g or t
  unsure (656): n is a, c, g or t
  unsure (671): n is a, c, g or t
  unsure (678): n is a, c, g or t
  unsure (690): n is a, c, g or t
  unsure (694): n is a, c, g or t
  unsure (696): n is a, c, g or t
aaagcttcagagcttcacattgacgatcacaaaagctcaaatctttcaaatgggtcttcctccccatgaagcaatcaaccagttcaaggagttaatggaccaagttgatgagcctcttaaaagaacattcaagaacgttcatcagggatatgtagtcgaaactttggagagatttcttaaagcaagagagggaaatgttacaaaagcccacaagatgttggtggatagcttacagtggaggctgcaaaatgggatagatgacattttagctaaaccgattattcctgctaatttctacagaggagttcgtgattcgcagctgataggactgtctggttacacaagagagggccttcccgtgtttgctatcggtgcaggcctcagcacattcgacaaagcatctatccattatatgtgcaatcacacattcaaataaatgaatatcgggatcgtgtgatactgccggctgcactaaaagaatggaaagtatatgggagtgtgtaaaggtttagatatagtggctaaacttcgcactgaccagttaactgcgaaacatctcacgtganattnagtccaggaaagttactttattataacgcccaatatncaactgttgagtttaacccntgagnaaaagtaaacnatttcaggggggntcacttaagaaggcnctccccnatttgcaaaagncggngncgttgcagggat

SEQ ID NO: 34 - protein, 144 aa, Helianthus tuberosus
  UNSURE (121): Xaa can be any naturally occurring amino acid
MGLPPHEAINQFKELMDQVDEPLKRTFKNVHQGYVVETLERFLKAREGNVTKAHKMLVDSLQWRLQNGIDDILAKPIIPANFYRGVRDSQLIGLSGYTREGLPVFAIGAGLSTFDKASIHXYVQSHIQINEYRDRVILPAALKE

SEQ ID NO: 35 - DNA, 1334 bp, Helianthus tuberosus
gcacgagaaagcttcagagcttcacattgacgatcacaaaagctcaaatctttcaaatgggtcttcctccccatgaagcaatcaaccagttcaaggagttaatggaccaagttgatgagcctcttaaaagaacattcaagaacgttcatcagggatatgtagtcgaaactttggagagatttcttaaagcaagagagggaaatgttacaaaagcccacaagatgttggtggatagcttacagtggaggctgcaaaatgggatagatgacattttagctaaaccgattattcctgctaatttctacagaggagttcgtgattcgcagctgataggactgtctggttacacaagagagggccttcccgtgtttgctatcggtgcaggcctcagcacattcgacaaagcatctatccattattatgtgcaatcacacattcaaataaatgaatatcgggatcgtgtgatactgccggctgcaactaaaaggaatggaaagtatattggcaagtgtgtaaaggttttagatatgagtggcctaaagctttctgcactgaaccagattaagctgctgacaacaatctctactgttgatgatctcagctacccagagaaaacgatcacatattatatagtaaacgtcccctacatattctcagcttgttggaaggttgtgaaaccgctgttgcaagagagaacaaagttaaaaatacgagtgttgcaaggtggaggtcgtgacgagctgttaaagataatggactacccttcactccctcatttctgccgaagagatgggtctggatccgggtccggttctgggtcaggagcgggcaattcgaatgataattgctactcattgaaccatccatttcatcaagaactttacaactacatgagggaactatcagggattgatgaaccaaaagagccaacaaagcaaggatcgatccacgtggaagtgccgatgggggaccacaaaggcgtagagttacacagaacgttggaatcggagctgatgaagctcagaacccgaaagagcctctctgggtctttagagaaagtcaagatcagtgattaaagatataattatgaagacgagtgattagtagtgtgactatgtggtgttgtttagtcattagttgctcattgtgcggatgtatttgtattagatctacacgcatcatgtatcatctatggtccatttaggtagtaggagttgcaatagagatgctttagtaatggacataaatagaaggttcatgttaactaactctgtaatgtatcaatcctgtatgtgttttagtaagtggtttagtcaaaaaaaaaaaaaaaaaaa

SEQ ID NO: 36 - protein, 339 aa, Helianthus tuberosus
MGLPPHEAINQFKELMDQVDEPLKRTFKNVHQGYVVETLERFLKAREGNVTKAHKMLVDSLQWRLQNGIDDILAKPIIPANFYRGVRDSQLIGLSGYTREGLPVFAIGAGLSTFDKASIHYYVQSHIQINEYRDRVILPAATKRNGKYIGKCVKVLDMSGLKLSALNQIKLLTTISTVDDLSYPEKTITYYIVNVPYIFSACWKVVKPLLQERTKLKIRVLQGGGRDELLKIMDYPSLPHFCRRDGSGSGSGSGSGAGNSNDNCYSLNHPFHQELYNYMRELSGIDEPKEPTKQGSIHVEVPMGDHKGVELHRTLESELMKLRTRKSLSGSLEKVKISD

SEQ ID NO: 37 - DNA, 471 bp, Hordeum vulgare
gcaccgtgcagcggagcagagcgccgcagcgtcacctcggaccaccgagggctgctggcaggcaggggggggagctcaaaaggcaaacaagactctctctctctctgctttctccccgtttgaggtttgacctctcctccagctccagaggccccccgcaagtctctcgcgacgaccgtcgccgggcaatggcggccgcctcggaggagtccgtcaagcagttctccgcgctcatggagcagctggaggagccgctcaagaccacattccagaatgtgcaccaaggatatccaagagggactctgctgcgttttctaaaggccagagaatggaacgtccccaaggcttataaaatgctaatggattgcttgaattggaggcttcagaatgagattgacagcgttctagccaaaccaatattgcccgctgatttgtatagatctattcgtgatacgctacttgttggattaa

SEQ ID NO: 38 - protein, 94 aa, Hordeum vulgare
MAAASEESVKQFSALMEQLEEPLKTTFQNVHQGYPRGTLLRFLKAREWNVPKAYKMLMDCLNWRLQNEIDSVLAKPILPADLYRSIRDTLLVGL

SEQ ID NO: 39 - DNA, 566 bp, Vitis sp.
  unsure (4): n is a, c, g or t
  unsure (111): n is a, c, g or t
  unsure (537): n is a, c, g or t
ttangaacataaaagacccaaaaagagctgcaaagttttgatcttcaattttgaggaaactgctggcattttgaaatgggaatcgttgctgaagacgcggtcaatcagttngaagcattgatgaaccaggttgacgagcctctgaagaaaacattccagaatattcatcaaggatatccaactggaactctggtgcgttttctaaaagcaagagaatggaatgttcccaaagcccacaaaatgttggtggattgcctaaactggagggtggaaaatgacattgacaatattttggcaaaacctatagttcctactgatttgtacagaggagtgcgtgattcacagctcataggattgtcaggttacacaaaagagggccttccggtgtttgctattggtgcagggttcaacacctttgacaaagcatctgttcactactatgtgcaatcacacattcaaatcaatgaatacccgggatcgtgtaaatttgcccttctgcatcaaaaaagcatgggcgacatattacttcttgtgtgnaaggccttaaatatgactgggcctaaagc

SEQ ID NO: 40 - protein, 132 aa, Vitis sp.
  UNSURE (12): Xaa can be any naturally occurring amino acid
MGIVAEDAVNQXEALMNQVDEPLKKTFQNIHQGYPTGTLVRFLKAREWNVPKAHKMLVDCLNWRVENDIDNILAKPIVPTDLYRGVRDSQLIGLSGYTKEGLPVFAIGAGFNTFDKASVHYYVQSHIQINEY

SEQ ID NO: 41 - DNA, 1447 bp, Vitis sp.
atttaagaacataaaagacccaaaaagagctgcaaagttttgatcttcaattttgaggaaactgctggcattttgaaatgggaatcgttgctgaagacgcggtcaatcagttgaagcattgatgaaccaggttgacgagcctctgaagaaaacattccagaatattcatcaaggatatccaactggaactctggtgcgttttctaaaagcaagagaatggaatgttcccaaagcccacaaaatgttggtggattgcctaaactggagggtggaaaatgacattgacaatattttggcaaaacctatagttcctactgatttgtacagaggagtgcgtgattcacagctcataggattgtcaggttacacaaaagagggccttccggtgtttgctattggtgcagggttcagcacctttgacaaagcatctgttcactactatgtgcaatcacacattcaaatcaatgaataccgggatcgtgtaattttgccttctgcatcaaaaaagcatgggcgacatattacttcttgtgtgaaggtcttagatatgactggcctaaagctttcagcactgagccagataaagctactgactattatgtcaaccatcgatgacttgaactacccagagaagacaaatacatattacattgtaaacgccccatatatattttcagcatgttggaaggttgtcaagcctcttttgcaggaaagaacaagaaaaaagattcaggtcttgccaggttgtggacgagatgagctgctaaagataatggattatgcatccctcccccatttctgtagaagagaaggctctggatcatcccgccattcagggaatgaaactgataattgctataccttggatcatcccttccatcaacagctttataactacatcaaagaacaagcctcaattattgcaccggctggaccatataaacaggggtctattcatgtgcatctgcccgagtcagctgtagaagaatcagagattgctaaaaccatagaatctgagttacagaagtttgggaatcagactaggctcacagactcattggatgccctgaaagtcagtgataacagaaactaaagagatcatttcctcattggcagctgctagacaagggatatgcatgtcacttctgccatgggggggcttcaactattatttgtagtcgtagcagctcactttatctcagagtgagttttgctagctcaagctaattatatgtacttgctattttatccacgggccttaatggtgtaagaaaaaggcacctaagaatagtaatccatgtatctctacctgcacatcttgtaagttaatttcgggaaattctgttctagccttcaactgtttcaggcttccatgtttgccagggacagtgaggaaggtgcaatataaactgtcaatgttctaggtccaaaaaaaaaaaaaaaaaaa

SEQ ID NO: 42 - protein, 326 aa, Vitis sp.
EALMNQVDEPLKKTFQNIHQGYPTGTLVRFLKAREWNVPKAHKMLVDCLNWRVENDIDNILAKPIVPTDLYRGVRDSQLIGLSGYTKEGLPVFAIGAGFSTFDKASVHYYVQSHIQINEYRDRVILPSASKKHGRHITSCVKVLDMTGLKLSALSQIKLLTIMSTIDDLNYPEKTNTYYIVNAPYIFSACWKVVKPLLQERTRKKIQVLPGCGRDELLKIMDYASLPHFCRREGSGSSRHSGNETDNCYTLDHPFHQQLYNYIKEQASIIAPAGPYKQGSIHVHLPESAVEESEIAKTIESELQKFGNQTRLTDSLDALKVSDNRN

SEQ ID NO: 43 - DNA, 565 bp, Zea mays
  unsure (8): n is a, c, g or t
  unsure (155): n is a, c, g or t
  unsure (276): n is a, c, g or t
  unsure (477): n is a, c, g or t
  unsure (528): n is a, c, g or t
  unsure (548): n is a, c, g or t
  unsure (555): n is a, c, g or t
  unsure (557): n is a, c, g or t
gggagagntggaaaaggcaggaaagacccggcttttgaccccaagtaccctgttgagggcaatggcggccacctccgaggaggcaatcaagcagttctcggcgctcatggagcagctagaggagccgctaaagagcacattccagaatgtgcatnaaggaaatctgagagggactttgatgcgttttctgaaggctagagaatggagtgtgcctaaagcttataaaatgctaatggattgcttaaactggagagtacagaatgagattgacatcgngttagctaaacccattctgccatctgatatatatagagttattcgggacacgttacttgttggattgacagggtactccaagcagggacaacctgtttatgcatttggtgtgggtcttagtactttcgacaaggcctcggtgaactactatgtgcaatcacacatcagatgaaatgaatatcgagaaccgtgttggcctgncggctgcattaaagaagtttgggagacagaattaatacctgctttgaaggntatggatatgactgggcttnaacttgntncacttgaa

SEQ ID NO: 44 - protein, 168 aa, Zea mays
  UNSURE (32): Xaa can be any naturally occurring amino acid
  UNSURE (72): Xaa can be any naturally occurring amino acid
  UNSURE (129): Xaa can be any naturally occurring amino acid
  UNSURE (139): Xaa can be any naturally occurring amino acid
  UNSURE (156): Xaa can be any naturally occurring amino acid
  UNSURE (163): Xaa can be any naturally occurring amino acid
  UNSURE (165)..(166): Xaa can be any naturally occurring amino acid
MAATSEEAIKQFSALMEQLEEPLKSTFQNVHXGNLRGTLMRFLKAREWSVPKAYKMLMDCLNWRVQNEIDIXLAKPILPSDIYRVIRDTLLVGLTGYSKQGQPVYAFGVGLSTFDKASVNYYVQSHIRXNEYREPCWPXGCIKEVWETELIPALKXMDMTGLXLXXLE

SEQ ID NO: 45 - DNA, 1400 bp, Zea mays
ccacgcgtccgggagagctggaaaaggcaggaaagacccggcttttgaccccaagtaccctgttgagggcaatggcggccacctccgaggaggcaatcaagcagttctcggcgctcatggagcagctagaggagccgctaaagagcacattccagaatgtgcatcaaggaaatctgagagggactttgatgcgttttctgaaggctagagaatggagtgtgcctaaagcttataaaatgctaatggattgcttaaactggagagtacagaatgagattgacatcgtgttagctaaacccattctgccatctgatatatatagagttattcgggacacgttacttgttggattgacagggtactccaagcagggacaacctgtttatgcatttggtgtgggtcttagtactttcgacaaggcctcggtgaactactatgtgcaatcacacatacagatgaatgaatatcgagatcgtgttgtcctgccggctgcatcaaagaagtttgggagacagattaatacctgcttgaaggttatggatatgactggcctcaagctgtctgcactgagccaaataaagatgttgacgatgattactactgttgatgaccttaattatcctgagaaaacggaaacttattacattgtaaatgctccatatgttttttcagcgtgttggaaggttgtgaagccactcttacaagaaagaactaaaaagaagatccaagtcctgtatggctctgggagggatgagttactgaaggtcatggactacgagtcacttccgcacttctgcaagagagaagggtcaggttcatccagcgactcgctggatggagtagattgctactcctacgaccaccctttccaccagcagctgtacaactacatgaagcagcagcaatctctgaatcaggactccgttggtcccagaaaacaaggctcggtccacgtggatgtgccctcgcctggccttgaggaggccaagattgcggagacgatcaaagcagagctccagaatttgaggggaagcggcggtctcgcccattcattcagcagcatccagatcgaaggtccatgagggcgcgcgccagtgacccgaagagaagctcttggtaatggtgcctcctgcttgcagtcactggctgcaggcttgaccggggcgaatagagagcgggattctaataactgtatccgcgattgttgtgatttctaattaaccaagtgggcgtgtatcgccatgcttgtactatccctgtatgtatgtatatataacggccaactggacggagtttatgtaactccctgctaattacttagaatgctcatcttttattttactccaatatagtgaaaatttcgcttaaaaaaaaaaaaaaccacaaacacaaaggggggg

SEQ ID NO: 46 - protein, 336 aa, Zea mays
MAATSEEAIKQFSALMEQLEEPLKSTFQNVHQGNLRGTLMRFLKAREWSVPKAYKMLMDCLNWRVQNEIDIVLAKPILPSDIYRVIRDTLLVGLTGYSKQGQPVYAFGVGLSTFDKASVNYYVQSHIQMNEYRDRVVLPAASKKFGRQINTCLKVMDMTGLKLSALSQIKMLTMITTVDDLNYPEKTETYYIVNAPYVFSACWKVVKPLLQERTKKKIQVLYGSGRDELLKVMDYESLPHFCKREGSGSSSDSLDGVDCYSYDHPFHQQLYNYMKQQQSLNQDSVGPRKQGSVHVDVPSPGLEEAKIAETIKAELQNLRGSGGLAHSFSSIQIEGP

SEQ ID NO: 47 - DNA, 733 bp, Zea mays
cgagcaaacagtcaaacactgggacgcggagtcgcggacgcctgcgcgatcagcgaacggaaggaagaccgtggaagcaaagaggcgcaagcgagcacggaacagatacaccttcaggtggcctccctccgactgccgactgaatcttccacctcgcttcgcgcctccggctccgcgccgggcccgcataatctgtgctcgggatcgcctcttcccgcggcaaatgggggccgactccgaggacgccgtcaagcagctcagcctcctcatggagcaagtggaggccccgctgaagagatcgtttcagaatatgcaccagggctatcccaaagaaacactggtgcgtttccttaaggctagagagtggaacgtaccaaaggctcataaaatgattgttgattctttggattggaggattgaaaatgaaattgatagtgtgctagagagacctatagtcccagtagatttatacagatcaatacgtgattcacaacttattggcctgtcaggatacacaaaggagggtctcccagtttttggcattggtgttggacatagcacatatgacaaagcttcggttcactactatgtgcaatctcatatccagattaatgagtaccgtgatcgtataattttgcctaggctgacacaacagtttgagcggcctgttgtcaggtgcataaaagttctggatatgactggtttgaagctatcagcactgagccaaataaag

SEQ ID NO: 48 - protein, 170 aa, Zea mays
MGADSEDAVKQLSLLMEQVEAPLKRSFQNMHQGYPKETLVRFLKAREWNVPKAHKMIVDSLDWRIENEIDSVLERPIVPVDLYRSIRDSQLIGLSGYTKEGLPVFGIGVGHSTYDKASVHYYVQSHIQINEYRDRIILPRLTQQFERPVVRCIKVLDMTGLKLSALSQIK

SEQ ID NO: 49 - DNA, 1542 bp, Zea mays
ccacgcgtccgcgagcaaacagtcaaacactgggacgcggagtcgcggacgcctgcgcgatcagcgaacggaaggaagaccgtggaagcaaagaggcgcaagcgagcacggaacagatacaccttcaggtggcctccctccgactgccgactgaatcttccacctcgcttcgcgcctccggctccgcgccgggcccgcataatctgtgctcgggatcgcctcttcccgcggcaaatgggggccgactccgaggacgccgtcaagcagctcagcctcctcatggagcaagtggaggccccgctgaagagatcgtttcagaatatgcaccagggctatcccaaagaaacactggtgcgtttccttaaggctagagagtggaatgtagcaaaggctcataaaatgattgtagaatgtttgaattggaggattcaaaatgaaattgatagtgtgctggagaggcctatcgtcccagtagatttatacagatcaatacgtgattcacaacttattggcctgtcaggatacacaaaggagggtctcccaatttttggcattggtgttgggcatagcacatatgacaaagcttcggtccactactatgtgcaatctcatatccagattaacgagtaccgtgatcgtataattttgcctaggctgacacaacagtttgggcggcctgttaccagctgtataaaagtgctggatatgactggtttgaagctatcagcactaagccaaataaagatgttgacttccatatcgacagttgatgatctaaattaccctgaaaagacagagacctattatgtagtcaacgttccatacatattttctgcttgttggaaggttgtgaagcccttattgcaggagaggacaaaaaagaaggtcaaagttttgactggctgcgggagagatgaacttctgaagatcatggactactcatcactcccccatttctgccgccgggaaggctctggatcatcgaagcattcgtctaccgacgtcgacaactgcttctcccttgaccatccattccacaaagaactgtacggtcacatcagagagcaagcgtcgcgcagggagctcatcaagatgggatcgttgcatgtcagcatccccgagccggacccagacgacgcgaagatcgtcgaggtcatccaggccgagttccaaaagattggcgagcaggacgagtccaccaacagccacaaagattgacatcatgacctctgatgttcatttctgtatttcggttaacagtccccccggttgcctggggatttatagcagcaaaagccttgcagtcgcatggtgcaagtgcaagcttgacttcatgtagctggagaggctgagagataaaccagccagtgtatattagatgcacaagaagcgataatcacctttttgttagtatataaccaacacatatatgatatatttagctgtttattaaaagaggaagtccatggaagcgcctttggcaaagtttttcgccctaaaaaaaaaaaaaaaaaaaaaaaaaaaaaaaaaaaaaaaaaaaag

SEQ ID NO: 50 - protein, 327 aa, Zea mays
MGADSEDAVKQLSLLMEQVEAPLKRSFQNMHQGYPKETLVRFLKAREWNVAKAHKMIVECLNWRIQNEIDSVLERPIVPVDLYRSIRDSQLIGLSGYTKEGLPIFGIGVGHSTYDKASVHYYVQSHIQINEYRDRIILPRLTQQFGRPVTSCIKVLDMTGLKLSALSQIKMLTSISTVDDLNYPEKTETYYVVNVPYIFSACWKVVKPLLQERTKKKVKVLTGCGRDELLKIMDYSSLPHFCRREGSGSSKHSSTDVDNCFSLDHPFHKELYGHIREQASRRELIKMGSLHVSIPEPDPDDAKIVEVIQAEFQKIGEQDESTNSHKD

SEQ ID NO: 51 - DNA, 699 bp, Zea mays
  unsure (15): n is a, c, g or t
  unsure (86): n is a, c, g or t
gcatgggcggcgtcnacaggaccggccaccccatcatcgtcggcttgctcgccaagcactactccgccaaccgcgacatggcgganttcaagagttttgtggtctacttcttcgacaagatctgtgccagaatccccagagggcaggagaaattcctctgcatcgttgatctcaagggctgggggtactcaaactgtgacgtccgggcatacattgccgctatagagatcttgcagaactactacccggagcggctcggcaaggcgctgatgatccacgtgccctacatcttcatgaaggcgtggaagatgatctaccccttcatcgacaccaacaccagggacaagttcgtgttcgtggaggacaagagcctgcaggagacgctgcggcgggagatcgacgaggggcagctcccagagttcctcggcggcaagatggacgtgatcccacttcaaggactatggcgtgcagcagcagcctcaggccgtgtaatgccatgcgtatatacagcatacacgagttgtgttgagctatagcaagctggtggctaggagcatagcatggcaataactgtgtagctgctgtgaaagtgaaactgaaacgttgcgctgtttagccgggtcaattgaccagctcaactgcagatctctggggctaccactatgaacagcaagaactgtttccgttatcttttcagcc

SEQ ID NO: 52 - protein, 151 aa, Zea mays
  UNSURE (5): Xaa can be any naturally occurring amino acid
  UNSURE (28): Xaa can be any naturally occurring amino acid
MGGVXRTGHPIIVGLLAKHYSANRDMAXFKSFVVYFFDKICARIPRGQEKFLCIVDLKGWGYSNCDVRAYIAAIEILQNYYPERLGKALMIHVPYIFMKAWKMIYPFIDTNTRDKFVFVEDKSLQETLRREIDEGQLPEFLGGKMDVIPLQ

SEQ ID NO: 53 - DNA, 1101 bp, Zea mays
cgatcctccacagcagcacccgccgccgccgcctcttcccttgcgcacctgctgctgtgcggatcggtgaggcggaggagtaggatggcgagcgcggccggaggcggagcggcgggggaaggggagtggcttaaggtatcccagctcaggcccatggtggaagcgcaggaccccaacgccaaggcggtggacaacctgacgctgcgtcggttcctgcgcgcgcgcgaccacgacgtggacaaggcctccgccatgttcctcaagttcctcaggtggcgggcggaggcggcgcccggcggcggcaccgtgcgggaggagcaggtgcgcggggagctggagcaggacaagatctacatgggcggcgtcgacaggaccggccgccccatcatcgtcggcttgctcgccaagcactactccgccaaccgcgacatggcggagttcaagagttttgtggtctacttcttcgacaagatctgtgccaggatccccagagggcaggagaagttcctcgccatcatggatctcaagggctggggctacgcaaactgcgacgtccgggcctacatcgcggccattgagatcatgcagaactactacccggagcggctgggcaaggcgctgatgatcaacgtgccctacatcttcctcaaggtgtggaagacgatgatctaccccttcatcgacgccaacaccagggacaagttcgtgttcgtggatgacaagagcctgcgggagacgctgcggcgggagatcgacgagagccagctcccggagttccttggcgggaagatgcctctcgtctccctcaaggactacgcccagcagcctcagcccgtttgcgagtgagtctgtcgtagcgatggtggccggccggtgacgtgagcgacccaaagccgaaagctgattcgatctagactaagctaatacagcctacaagagggaggaagagaggccctacccgtggaattaagtcattagtttgtggcccaattcaataagaaagtaaatgtggtgtgtgaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 54 - protein, 253 aa, Zea mays
MASAAGGGAAGEGEWLKVSQLRPMVEAQDPNAKAVDNLTLRRFLRARDHDVDKASAMFLKFLRWRAEAAPGGGTVREEQVRGELEQDKIYMGGVDRTGRPIIVGLLAKHYSANRDMAEFKSFVVYFFDKICARIPRGQEKFLAIMDLKGWGYANCDVRAYIAAIEIMQNYYPERLGKALMINVPYIFLKVWKTMIYPFIDANTRDKFVFVDDKSLRETLRREIDESQLPEFLGGKMPLVSLKDYAQQPQPVCE

SEQ ID NO: 55 - DNA, 761 bp, Oryza sativa
  unsure (69): n is a, c, g or t
  unsure (73): n is a, c, g or t
cttacacggcacgagcttacaccgtttgacctcgccctgctcaccgcgaaggctcgcccccctccctcnaaantccccgccgccgtcaccggcggcaggcagcaatggcggccgcttcggaggaggccatcaagcagttctccgcgctgatggagctgctggatgagccgctcaagaccacattccagcatgtccatcaaggatacgcaagaggaactctggtgcgttttctaaaggccagagaatggaatgttccgaaagcacataaaatgttaatggattgcttaaattggaggatacaaaatgggattgacagcgttctggctaaacctatagtcccttctgatttatacagaactattcgggatacgctgctggttggattgacaggatactccaagcagggacaacctgtctatgcattcggtgttgggcttagtacccttgacaaggcatcggtgcactattatgtgcaatcacacatacagatgaatgaatatcgagatcgtgttgtactgccgaaagcctctaagatgttcgggaaacagattaacacttgcctaaaggttatggatatgacggggctgaagctttctgccttgaaccaaataaagatgttatctacgataacagccatcgatgaccttaactatcctgagaaaacagagacctatttcattgtcaatgctccatatgttttttcaagcatgttggaaggttgtgaagcctcttctacaaggaaagaacaaaaaggaaaatta

SEQ ID NO: 56 - protein, 218 aa, Oryza sativa
MAAASEEAIKQFSALMELLDEPLKTTFQHVHQGYARGTLVRFLKAREWNVPKAHKMLMDCLNWRIQNGIDSVLAKPIVPSDLYRTIRDTLLVGLTGYSKQGQPVYAFGVGLSTLDKASVHYYVQSHIQMNEYRDRVVLPKASKMFGKQINTCLKVMDMTGLKLSALNQIKMLSTITAIDDLNYPEKTETYFIVNAPYVFQACWKVVKPLLQGKNKKEN

SEQ ID NO: 57 - DNA, 1612 bp, Oryza sativa
gcacgagcttacacggcacgagcttacaccgtttgacctcgccctgctcaccgcgaaggctcgcccccctccctcttccctccccgccgccgtcaccggcggcaggcagcaatggcggccgcttcggaggaggccatcaagcagttctccgcgctgatggagctgctggatgagccgctcaagaccacattccagcatgtccatcaaggatacgcaagaggaactctggtgcgttttctaaaggccagagaatggaatgttccgaaagcacataaaatgttaatggattgcttaaattggaggatacaaaatgggattgacagcgttctggctaaacctatagtcccttctgatttatacagaactattcgggatacgctgctggttggattgacaggatactccaagcagggacaacctgtctatgcattcggtgttgggctcagtacccttgacaaggcatcggtgcactattatgtgcaatcacacatacagatgaatgaatatcgagatcgtgttgtactgccgaaagcctctaagatgttcgggaaacagattaacacttgcctaaaggttatggatatgacggggctgaagctttctgccttgaaccaaataaagatgttatctacgataacagccatcgatgaccttaactatcctgagaaaacagagacctatttcattgtcaatgctccatatgttttttcagcatgttggaaggttgtgaagcctcttctacaagaaagaacaaaaaggaaaattaaagtcctgtacggctcaggaagagatgaattactaaaggttatggactatgaggcactcccaaacttttgcaagcgagaaggatcaggctcgtcgaatgattcgtcggatggagttgattgctactcctatgatcacccttttcaccaggagctgtataattacatcaaacagcaagccctgaatgaagacttcatcggtcccataaagcaaggctcaatgcatgtggatgtgcccacacctgatctggaagaggccaagatcatggagacgatcgaatcggagctccacaaattcagtggagctaatggcctctcgcattcattcaacaagatcaagattgaaggtccgtgatgttgcccgtgatcatatctcgtgacggagacgacgatctgcggagatattatgcttatccatctccagccccagggaacctacggtggggttatagcactccttgcttgcaatctctagctgcaggcttgactaggatccacgagtagaaagaggttagtaattgtgatgcgattctaataaccgaatccgtattatctgaaagtgtagccagttctttttctaattaacctagcgactgtatcatctgcgacacgttactatttcagtgcttatggcaactgggaaggaaatgtgatgtttccagtccttccgagtaagttgctgccctaaatatatatgtaacagtgtatgtatagcctctagctgccttttgattgcagtggtatatatcaagtgctgtactcactgctaagaatgaatcatctgcatgtttcatttcactggatgctgtgaaatttggtaaaaaaaaaaaaaaaaaaaaaaaaaaaaa

SEQ ID NO: 58 - protein, 335 aa, Oryza sativa
MAAASEEAIKQFSALMELLDEPLKTTFQHVHQGYARGTLVRFLKAREWNVPKAHKMLMDCLNWRIQNGIDSVLAKPIVPSDLYRTIRDTLLVGLTGYSKQGQPVYAFGVGLSTLDKASVHYYVQSHIQMNEYRDRVVLPKASKMFGKQINTCLKVMDMTGLKLSALNQIKMLSTITAIDDLNYPEKTETYFIVNAPYVFSACWKVVKPLLQERTKRKIKVLYGSGRDELLKVMDYEALPNFCKREGSGSSNDSSDGVDCYSYDHPFHQELYNYIKQQALNEDFIGPIKQGSMHVDVPTPDLEEAKIMETIESELHKFSGANGLSHSFNKIKIEGP

SEQ ID NO: 59 - DNA, 1084 bp, Oryza sativa
gcacgaggcaattcaagaggagaggagaggagagctagctaaggcagccatggattactgcaagcagcaggagcgagacgggcaccgcgacgatggcgatgtgacggagtggaagaaggtggccgagctgagagccgtcgtcgaagcccaggaccctgcatgcaaggaggaggacgactaccagctgcgccggttcctgcgcgcgagagaccacaacatcggcaaggcgtcggcgatgctggtgaagtacctgcagtggaagcgcgaggtgaagcccggcggccgcgccatcgccgacgaggaggtgcgcggcgagctggcgcaggagaagctctacatgcagggctacgaccggcaggggcgccccctggtgtacggcttcggcgcccgccacttcccggcgcgccgcgacctcgacgagttcaagcgctacgtcgtctacgtcctcgaccgcacctgcgcccgcctcggcggcaatggcgggcaggagaagttcgccgccgtggccgacctgcaggggtgggggtactacggcaactgcgacatccgcgcgtacgtggcggcgctggagatcatgcagaactactacccggagaggctggggagggtgttcttgatccatgtcccctacgtgttcatggcggcctggaagatcatctaccccttcatcgacgacaacaccaagaagaagttcgtcttcgtcgccgacaaggacctccacgccacgctccgcgacgccatcgacgactccaacctcgccgaggactacggcggcaagctcaagctcgtctcgccccttattaatggcgccaccgaatccaatcgccgccggtagatagctctcgcgtcgcgtgcatgaagatcgatatgatgtatgtacacccatctcgagatccaatttaatggtatgtatgtagcacgtgtacggtgtacgtgaatgtatgttactagtatgtatacgggacaggaggacactacgaattcgaggacgtacgtgcgtgctatatacattgaattacggctctgaacagtactgatcatgaatgatcactgttgatgagaaatgcaagttcctctgcatcaa

SEQ ID NO: 60 - protein, 261 aa, Oryza sativa
MDYCKQQERDGHRDDGDVTEWKKVAELRAVVEAQDPACKEEDDYQLRRFLRARDHNIGKASAMLVKYLQWKREVKPGGRAIADEEVRGELAQEKLYMQGYDRQGRPLVYGFGARHFPARRDLDEFKRYVVYVLDRTCARLGGNGGQEKFAAVADLQGWGYYGNCDIRAYVAALEIMQNYYPERLGRVFLIHVPYVFMAAWKIIYPFIDDNTKKKFVFVADKDLHATLRDAIDDSNLAEDYGGKLKLVSPLINGATESNRRR

SEQ ID NO: 61 - DNA, 553 bp, Glycine max
  unsure (356): n is a, c, g or t
  unsure (389): n is a, c, g or t
  unsure (438): n is a, c, g or t
  unsure (483): n is a, c, g or t
  unsure (486): n is a, c, g or t
  unsure (500): n is a, c, g or t
  unsure (522): n is a, c, g or t
  unsure (542): n is a, c, g or t
cctacatacataggaagctacaacatagtacaaactcacctccaagtccacgcttttgttcttgcagagtaagagagaggaggtggacaaataaagctataatttttagaggggttaccaccctcaccttctgccaaaccaaacccacccttttctgtcttcaagctactatcgtgctgagagctgaacaagaagatggggggtggaaatcaagaggcagtcaagcagctgcagaccctgatggaaaatgtggatgatgagcagctgagaatacatccaagattatgcaccagggttatcaaacgggaaacgttaatacggtttctcaaagctagggactggagtgttgccaaagnccataaaatggtaatgatttgtttgaactgganggtggaaaatgagattgacaatggttttaaggaagctatccctacggantttgtcaaaggcatacggggattcccaaccttataggaatggccnggntactcaaaggaggntcaactgtcaatgctggttggnggttgggctcagtcatatgntaaagcatctg

SEQ ID NO: 62 - protein, 57 aa, Glycine max
MGGGNQEAVKQLQTLMENVDDEQLKNTFQIMHQGYQTETLIRFLKARDWSVAKAHKC

SEQ ID NO: 63 - DNA, 1524 bp, Glycine max
gcacgagcctacatacataggaagctacaacatagtacaaactcacctccaagtccacgcttttgttcttgcagagtaagagagaggaggtggacaaataaagctataatttttagaggggttaccaccctcaccttctgccaaaccaaacccacccttttctgtcttcaagctactatcgtgctgagagctgaacaagaagatggggggtggaaatcaagaggcagtcaagcagctgcagaccctgatggaaaatgtggatgatgagcagctgaagaatacattccagattatgcaccagggttatcaaacggaaacgttaatacggtttctcaaagctagggactggagtgttgccaaagcccataaaatgttaattgattgtttgaactggagggtggaaaatgagattgacaatgttttaaggaagcctatccctacggatttgtacaaagccatacgggattctcaacttataggaatgtctggttactcaaaggaggatctacctgtcattgctgttggtgttgggctcagtacatatgataaagcatctgacaaatactatatacaatcacacatccaactgaatgaatatagggatcgagtgatcttgccaacagctacaaggaaacatggacgatacattggcacctgtgttaaagtgttggatatgtctggtttaaaattttctgcattgaatcaattgaggttgttgactgctatatctacaatagatgacttgaactatccggaaaagacagacacatactatattgttaatgcaccatatgtattctcagcgtgttggaaggttgtgaagcctcttttgcaagaaagaaccaggagaaaaatccaggtgctgcaaggttgtgggaaggaggaattactaagggtcatggactatgcatcccttccacacttctgcagaaaagaagattccaagtcatccaaacatcatgcttcaggaaactctgaaaattgtttctccttcaatcatgccttccatcaacaactctacaatcacatcaagcaacaagccatcattatggagtcaatttcaccaatcagacaagggtccttctgtgtagacataccagagccagaccctgatgatgccaaaatagccaagaccatagaaaatgagttccacaaattggagaatcagaagaatggttttaccaactcactaactggtcttacagttaatggccattgaaagctatgctactaaagctagtaactgtttttggcctctcctgagccacttttatttgttgattactttatggtcccttttggaaaaggagggttatacttgtaggtcatacttatacccggttattagatctaatattgtaatgtttgcatcaactagatgcaaaattcttcaggcagaccttaatctaatttctacaaccaccttgagatgataagcatatgatatatgttcaatgtagaaaagatggcaccatgctacaattcatatggttgtctaggtacattaaaaaaaaaaaaaaaaaa

SEQ ID NO: 64 - protein, 338 aa, Glycine max
MGGGNQEAVKQLQTLMENVDDEQLKNTFQIMHQGYQTETLIRFLKARDWSVAKAHKMLIDCLNWRVENEIDNVLRKPIPTDLYKAIRDSQLIGMSGYSKEDLPVIAVGVGLSTYDKASDKYYIQSHIQLNEYRDRVILPTATRKHGRYIGTCVKVLDMSGLKFSALNQLRLLTAISTIDDLNYPEKTDTYYIVNAPYVFSACWKVVKPLLQERTRRKIQVLQGCGKEELLRVMDYASLPHFCRKEDSKSSKHHASGNSENCFSFNHAFHQQLYNHIKQQAIIMESISPIRQGSFCVDIPEPDPDDAKIAKTIENEFHKLENQKNGFTNSLTGLTVNGH

SEQ ID NO: 65 - DNA, 615 bp, Triticum aestivum
  unsure (352): n is a, c, g or t
  unsure (369): n is a, c, g or t
  unsure (434): n is a, c, g or t
  unsure (441): n is a, c, g or t
  unsure (447): n is a, c, g or t
  unsure (477): n is a, c, g or t
  unsure (494): n is a, c, g or t
  unsure (538): n is a, c, g or t
  unsure (555): n is a, c, g or t
  unsure (566): n is a, c, g or t
  unsure (585): n is a, c, g or t
  unsure (599): n is a, c, g or t
cgcaacgacaaaccgacccaccgaccaagacgagagccggtcgaccgacgactcggaggagaccgtctcctccccctcgtccaccgccccctgaacctgaacgtctttccctctgaagcctgaatccgcgccagaaccccgtagaatcggccgccccgctccgctcggctcccctcccgcctcctcgagcgcgcgcaatgggggccgcctgcgacgacgccgtccagcagctcgcccacctcctcgaccaagtcgaggagcgctgaagaagacttccaagaatgtgcaccaaggatgtccatcagagacactaatgcgcttccttaaagctagagagtggcatgttactaangctcataaaagcttggnggatgtttggattggaggatacaaaatgaaattgacagtatactgggagaaactataacccaatngactggntagatngatacgagaacacacttgttgggtttatcnggatatcaaaggaggcncccaatgtttgccttggggttgggaagacaattgacaacttcgnccatacaagtgcatccnaattcagttanatacgtgatgttattgcanggacaaaattttcnactaaacactttaagt

SEQ ID NO: 66 - protein, 79 aa, Triticum aestivum
  UNSURE (22): Xaa can be any naturally occurring amino acid
  UNSURE (52): Xaa can be any naturally occurring amino acid
  UNSURE (58)..(59): Xaa can be any naturally occurring amino acid
MGAACDDAVQQLAHLLDQVEEXLKKTSKNVHQGCPSETLMRFLKAREWHVTXAHKSLXXCLDWRIQNEIDSILGETITQ

SEQ ID NO: 67 - DNA, 1523 bp, Triticum aestivum
cgcaacgacaaaccgacccaccgaccaagacgagagccggtcgaccgacgactcggaggagaccgtctcctccccctcgtccaccgccccctgaacctgaacgtctttccctctgaagcctgaatccgcgccagaaccccgtagaatcggccgccccgctccgctcggctcccctcccgcctcctcgagcgcgcgcaatgggggccgcctgcgacgacgccgtccagcagctcgcccacctcctcgaccaagtcgaggagccgctgaagaagacgttccagaatgtgcaccagggatgtccatcagagacactagtgcgcttccttaaagctagagagtggcatgtaactaatgctcataaaatgcttgtggattgtttgaattggaggatacaaaatgaaattgacagtatactggagaaacctataaccccagtagacttgtatagatcgatacgagaatcacagcttgttgggttatcgggatactcaaaggagggcgtcccagtgtttgcctttggtgttggacagagcacatatgacaaagcttcggtccattactatgtgcaatctcatattcagatcaatgagtaccgtgatcgtattattctgcccatggcgacgaagaagtttagacgacctataaccacctgtataaaggttcttgatatgactggtctgaagttgtcagcactgagcctattgaagattttgactgcaatatctgctgtcgatgaactgaattaccctgaaaaggccgagacctattatattgtgaatgctccatatatattctcagcgtgttggaaggttgtgaaacctctactgcaagagaggacaagaaagaaggttcatgttttgagtggtcgtgggaaagatgagctcctaaagattatggaccattcctccatcccccatttctgtcgacgagagggttcatcaaaagcttcgttgagcagcatcgatgactgcttctcgctcgaccaccctttccaccaagagctctaccattacatcgagcagcaggcgctgaatcaggaactcatcaagcagggttctttgcacgtagacatccccgatcaagaccccgatgacgccatgattgtggaggtcatccaggccgagtttcacaagctcggtgaacagaatgggtctgccgatggcgaccaaaaataacggtgtccgtgatgtcagcggtgtggcacgacagatgtgtgttgctgtgatgaaactgatgatccatttcggtgtttgcgatgtttgcttgaccagcctgctgttgtttgtggggtgaccagttccatggtgcaagactgaggtagaagaagcaaccgatgtatactagatagaaataaccacctattcacctgttgtatactttggcaatgtgctgtcatatgtatgtcctctaagctaggagtaaatcatcctgtaacatggatgcaaaaataatcttgagagtaccatccttcaatcagaaataaatggtgcatcttgacctttgccaaaaaaaaaaaaaaaaaa

SEQ ID NO: 68 - protein, 325 aa, Triticum aestivum
MGAACDDAVQQLAHLLDQVEEPLKKTFQNVHQGCPSETLVRFLKAREWHVTNAHKMLVDCLNWRIQNEIDSILEKPITPVDLYRSIRESQLVGLSGYSKEGVPVFAFGVGQSTYDKASVHYYVQSHIQINEYRDRIILPMATKKFRRPITTCIKVLDMTGLKLSALSLLKILTAISAVDELNYPEKAETYYIVNAPYIFSACWKVVKPLLQERTRKKVHVLSGRGKDELLKIMDHSSIPHFCRREGSSKASLSSIDDCFSLDHPFHQELYHYIEQQALNQELIKQGSLHVDIPDQDPDDAMIVEVIQAEFHKLGEQNGSADGDQK

SEQ ID NO: 69 - DNA, 679 bp, Triticum aestivum
  unsure (448): n is a, c, g or t
  unsure (546): n is a, c, g or t
  unsure (572): n is a, c, g or t
  unsure (577): n is a, c, g or t
  unsure (586): n is a, c, g or t
  unsure (618): n is a, c, g or t
  unsure (620): n is a, c, g or t
  unsure (635): n is a, c, g or t
  unsure (637): n is a, c, g or t
  unsure (644): n is a, c, g or t
  unsure (653): n is a, c, g or t
  unsure (659): n is a, c, g or t
cggtagggggagctcaaaaggcaaacaagacactctgctttctccccgtttgaggtttgacctctccccagctccagagccccgcaagtctccccctcctcccctcgcgacgaccgtcgccggcaatggcggccgcctcggaggaggccatcaagcagttctccgtgctcatggagcagttggaggagcccctcaagaccacattccaagaatgtgcaccaaggatatccaagagggactctgctgcgctttctcaaggccaagagaatggaacgttccgaaagcatataaaatgctaatggattgcttgaattgggaggcttcagaatgagattgacagcgttctaactaaaccaatattgcccgctgatttgtatagatctattccgtgatacactgcttgttggattaacaagatattccaagcaaggtcaacctgtctatgcanttggtgttgggctcaatactttgacagacatcggtgaactacaattgcagtccacatacagatgaattatatcagatcgtgttgcctgcaagtgatcnaaattccggaaacagttacaccgctnaaatnaggtatacngctaacttcgcttacaataagtttacacatanantgttgtaccatttcnanaaacggntttattgancccaanttttcgagtgaggtgaccct

SEQ ID NO: 70 - protein, 119 aa, Triticum aestivum
  UNSURE (107): Xaa can be any naturally occurring amino acid
MAAASEEAIKQFSVLMEQLEEPLKTTFQNVHQGYPRGTLLRFLKAREWNVPKAYKMLMDCLNWRLQNEIDSVLTKPILPADLYRSIRDTLLVGLTRYSKQGQPVYAXGVGLNTLTDIGE

SEQ ID NO: 71 - DNA, 1660 bp, Triticum aestivum
cggtagggggagctcaaaaggcaaacaagacactctgctttctccccgtttgaggtttgacctctccccagctccagagccccgcaagtctccccctcctcccctcgcgacgaccgtcgccggcaatggcggccgcctcggaggaggccatcaagcagttctccgtgctcatggagcagttggaggagcccctcaagaccacattccagaatgtgcaccaaggatatccaagagggactctgctgcgctttctcaaggccagagaatggaacgttccgaaagcatataaaatgctaatggattgcttgaattggaggcttcagaatgagattgacagcgttctagctaaaccaatattgcccgctgatttgtatagatctattcgtgatacactgcttgttggattaacaggatattccaagcagggtcaacctgtctatgcatttggtgttgggctcagtacctttgacagagcatcggtgaactactatttgcagtctcacatacagatgaattagtatcgagatcgtgttgtcctgccaggtgcatctgagatgtccggaaaacagattaacacctgcttgaaagttatggatatgactggcctgaagctttctgctttgaaccaaataaagatgttgagcacgataacagctgttgatgacctcaattatcctgagaaaaccgagacgtattacattgtgaacgctccatatgttttttcggcatgttggaaggttgtgaagcctcttttacaagagcgaactaaaaagaagatcaaagtcttgtatggccctggaagagatgaattactgaaggttatggactacgcgtcactcccgcacttctgcaagagggaagggtccggttcgggttcgtcgtcggatgaagtcgactgctactcgtatgatcatccattccaccaggagctgtacaactatgtgaagcagcaagctctgaggaaccaggacagcgtcggccccgcgaagcaagggtcgatgcatgtgagggtgccgacgccggacctggaggaggccaagatcatggagacgatccagtcggagctccacaacctcaaggggggcgacggcatttcccgctccttcagcaggatcaccatcgaaggtccatgatatcttatttcctgctcgtatccaagatcgtcgtggatgtgatccatgatgatcggagtgcctcgagatgcgcggagcaggtaatcgcttattttatcttatttgacgccagaagattattctggggtttataacggttcttgcttgcgttgtaaccgctggctgcaaagctcgagtaggatcatatcagtagaggaagtagcagcagtagcatcggattctaataaccgagtgagtctgtatcgtggtgtcgaagatggtagtaattagtttgattaacctgtctaatggatgtaccatttgcgagttactgtttccatgcttctcatggcagggaaattgccatgctcccagacatgagtaacaccagcactatgtatcggaccaatcagtatatagtatatgtatgtatatgtaatcgccttctgatgttgcaactggtatatcattatgtatttgatttgatgttacctgaaccacgacttaaaaagaaatctgctgtctgtttcaaaaaaaaaaaaaaaaaa

SEQ ID NO: 72 - protein, 335 aa, Triticum aestivum
  UNSURE (131): Xaa can be any naturally occurring amino acid
MAAASEEAIKQFSVLMEQLEEPLKTTFQNVHQGYPRGTLLRFLKAREWNVPKAYKMLMDCLNWRLQNEIDSVLAKPILPADLYRSIRDTLLVGLTGYSKQGQPVYAFGVGLSTFDRASVNYYLQSHIQMNXYRDRVVLPGASEMSGKQINTCLKVMDMTGLKLSALNQIKMLSTITAVDDLNYPEKTETYYIVNAPYVFSACWKVVKPLLQERTKKKIKVLYGPGRDELLKVMDYASLPHFCKREGSGSGSSSDEVDCYSYDHPFHQELYNYVKQQALRNQDSVGPAKQGSMHVRVPTPDLEEAKIMETIQSELHNLKGGDGISRSFSRITIEGP

SEQ ID NO: 73 - DNA, 407 bp, Triticum aestivum
  unsure (15): n is a, c, g or t
  unsure (25): n is a, c, g or t
  unsure (331): n is a, c, g or t
  unsure (341): n is a, c, g or t
  unsure (353): n is a, c, g or t
  unsure (355): n is a, c, g or t
  unsure (397): n is a, c, g or t
gcgccaccgttgcancagcaatggnctacagtactgaagatgagcaccaacacggccatggctatggcgacggtgacgacgcggcggagtggaagaaggtggcggagctgagggccgtcgtcgaggcccaggaccccgctgccaaggaggaggatgacttttcgctgcgacgattcctgcgtgcccgggaccacaacatcggcaaggcgtcggccatgctcctccagtacctttcctggaggcgtgttgccaagccccatggctccatctcgggcgacgaggtgcgcgaacgagatttgcaaaggataagagtccgcatgcaagggcttcnaaccgtctcnatccgccccatngngtatctcctattgggggcacgaaaatttcccctgccccgggngtgacccttt

SEQ ID NO: 74 - protein, 89 aa, Triticum aestivum
  UNSURE (2): Xaa can be any naturally occurring amino acid
MXYSTEDEHQHGHGYGDGDDAAEWKKVAELRAVVEAQDPAAKEEDDFSLRRFLRARDHNIGKASAMLLQYLSWRRVAKPHGSISGDEVR

SEQ ID NO: 75 - DNA, 541 bp, Triticum aestivum
  unsure (356): n is a, c, g or t
  unsure (377): n is a, c, g or t
  unsure (438): n is a, c, g or t
  unsure (502): n is a, c, g or t
gcgctatgtggtctatgtttttgacaaaatctgcaccaagctgccggcagggcaggagaagtttgcggcggtgatagacctgaagggatgggggtatgcaaactgcgacatccgtgggtacctggcagggctggacatcatgcagagctattacccagagcggctgggccgcgtgttcctgatccacgtgccctacctattcatggctgcgtggaagattgtgtaccccttaatcgatgacaagaccaagaagaatttgtgttcgtcgctgatagggaccttgacgccacacttcgagacgccatcgacgagtcccagctccctgaaggagtacggtgggcaagctcaagctctangcctacaacagttcaccatcngtccaatccatctgatgatcaatcgatagtgatgacatgtgacatatgcaaataagttgcngctccgacgaagcagcccgagagaagcgacgatccttgcaagtgtggcagtcgctcacactcanctacttatgtaatttttttacaaaaaaattgggggactc

SEQ ID NO: 76 - protein, 109 aa, Triticum aestivum
RYVVYVFDKICTKLPAGQEKFAAVIDLKGWGYANCDIRGYLAGLDIMQSYYPERLGRVFLIHVPYLFMAAWKIVYPLIDDKTKEEFVFVADRDLDATLRDAIDESQLPE

SEQ ID NO: 77 - DNA, 524 bp, Triticum aestivum
  unsure (357): n is a, c, g or t
  unsure (364): n is a, c, g or t
  unsure (411): n is a, c, g or t
  unsure (423): n is a, c, g or t
  unsure (429): n is a, c, g or t
  unsure (436): n is a, c, g or t
  unsure (448): n is a, c, g or t
  unsure (459)..(460): n is a, c, g or t
  unsure (463): n is a, c, g or t
  unsure (469): n is a, c, g or t
  unsure (484): n is a, c, g or t
  unsure (486)..(487): n is a, c, g or t
  unsure (507): n is a, c, g or t
  unsure (519): n is a, c, g or t
ggtactgatgagcgccaatatggccatggcggtgacggcgacgcggcggagtggaagaaggtggcggagctcagggagttcgttgaggcacaggacccctctgccaaggaggaggatgacttcgcgctgcggcggttcctgcgcgcccgggaccacaacatcaacaaggcatcggtgatgcttctccggtatcttgcctggaagcgtgtcaccaagccccatggcttcatctccgacgacaaggtgcgtggcgaagatcgcaaagggaaagagaccgccaccaaggttttgaccgtcttggtcgccccatgtcatatctctatggtgggcgccacttccctgtccggggtgatcacnaagattnaagcgctatgttgtccaatgttttttgacaaaaatcctgcaaccaancttcccggcaangggaangaaaaantttgcgggggtnaataaaacctnnaanggaatngggggtatgcaaatngnnaaatccttgggttacctggnaagggctggganataat

SEQ ID NO: 78 - protein, 76 aa, Triticum aestivum
GGDGDAAEWKKVAELREFVEAQDPSAKEEDDFALRRFLRARDHNINKASVMLLRYLAWKRVTKPHGFISDDKVRGE

SEQ ID NO: 79 - DNA, 542 bp, Zea mays
ttcggagagagagagaggagtgggagacccgcgagaggctgccgtgtagggaccgtagactcagcgactgcgaaggagggataaggggatggccgggatcggaccgatcaggcaggactgggagccggtcgttgtgcggaagaaggcacccaccgccgccgccaagaaggatgagaaggccgtcaacgccgcgcgccgcgccggtgcggagatcgataccatgaagaagtacaacgctggtacgaacaaggcggcatccagcggtacatccctcaacaccaagcgcctcgacgacgacaccgaaaacctcgcccatgagcgagttccaagtgatctgaagaagaatctcatgcaagcaaggctcgataagaagctgacacaggcacaacttgctcagatgataaatgagaagccacaggtgattcaggagtatgaatcaggcaaggcaatccccaaccagcagatcattagcaagctcgagagggccctgggaaccaagttgcgtgcaaggaaatagcttttctacgagtttggtcccggac

SEQ ID NO: 80 - protein, 142 aa, Zea mays
MAGIGPIRQDWEPVVVRKKAPTAAAKKDEKAVNAARRAGAEIDTMKKYNAGTNKAASSGTSLNTKRLDDDTENLAHERVPSDLKKNLMQARLDKKLTQAQLAQMINEKPQVIQEYESGKAIPNQQIISKLERALGTKLRARK

SEQ ID NO: 81 - DNA, 565 bp, Oryza sativa
  unsure (442): n is a, c, g or t
  unsure (487): n is a, c, g or t
gttctaaccagaaccttctcttcttccttgttcgttcatcccctaaccctttctttgttcatcttgttcttcctcttgtcgtctcgtcgagatggccgggattggtccgatcaggcaggactgggagccggtggtggtgcggaagaaggcgcccaccgccgccgccaagaaggatgagaaggccgtcaacgccgcccgccgctccggcgccgagatcgagaccatgaagaagtataacgctggaacaaacaaggcggcgtccagtggcacatccctcaacaccaagcggctggatgacgacaccgagagccttgcccatgagcgtgtctcaagtgacctgaagaaaaactcatgcaagcaaggctgggacaagaagatgacccaggcacagcttgcacagatgatcaatgagaagccccaggtgatccaggagtacgatcangtaaactatccgaacagcagtatcgggaagctgaaaggccttggnacaaactcgcggcaagaaataatgtcacaataggcctgaagcatatgttgggcaacaaagccaaaatgttgctaccat

SEQ ID NO: 82 - protein, 142 aa, Oryza sativa
  UNSURE (117): Xaa can be any naturally occurring amino acid
MAGIGPIRQDWEPVVVRKKAPTAAAKKDEKAVNAARRSGAEIETMKKYNAGTNKAASSGTSLNTKRLDDDTESLAHERVSSDLKKNSCKQGWDKKMTQAQLAQMINEKPQVIQEYDXVNYPNSSIGKLKGLGTNSRQEIMSQ

SEQ ID NO: 83 - DNA, 528 bp, Glycine max
  unsure (503): n is a, c, g or t
  unsure (521): n is a, c, g or t
  unsure (525): n is a, c, g or t
  unsure (527): n is a, c, g or t
aagaaccctagacagtcacagaaccattccatagaaatgtcaggtgttggccctctttctcaagattgggaacccgtcgtcctccgcaagaaggctcccactgccgccgccaagaaggatgagaaagccgtcaacgccgcccgccgctccggcgccgaaatcgaaaccctaaaaaaatataatgctgggacaaataaagcagcatctagcagcacttcattgaacactaagaggctggatgatgatactgagagtctagctcatgagaaggtaccaactgaacttaagaaggccataatgcaagctaggatggacaagaaacttactcagtctcagcttgctcaactgatcaatgagaagcctcaagtgatccaggagtacgagtcaggaaaggccattccaaaccagcagataattggcaagttggaaagagcccttggagctaaattgcgtggcaagaaataagggacttaatgtcatgttgcgcgtttattttgctatgntggtcaactatgggggtnttananc

SEQ ID NO: 84 - protein, 142 aa, Glycine max
MSGVGPLSQDWEPVVLRKKAPTAAAKKDEKAVNAARRSGAEIETLKKYNAGTNKAASSSTSLNTKRLDDDTESLAHEKVPTELKKAIMQARMDKKLTQSQLAQLINEKPQVIQEYESGKAIPNQQIIGKLERALGAKLRGKK

SEQ ID NO: 85 - DNA, 624 bp, Triticum aestivum
  unsure (512): n is a, c, g or t
  unsure (612): n is a, c, g or t
tgtgaactcgagagaccgagcgaggaaagttgccgtgtgagacctgagagtcagggagatatggctgggattggtcctatcaggcaggactgggagccgatagtggtgcggaagaaggcgcagaacgccgccgacaagaaggacgaaaaggccgtcaacgctgcccgccgctccggcgccgagatcgacaccaccaagaagtacaacgctggaacgaacaaggctgcatctagcggaacttccctcaacaccaagcggctcgacgacgacaccgagaacctttcccatgagcgtgtttcaagtgacctgaagaaaaaccttatgcaagcaagactggataagaagatgacccaggcacaacttgctcagatgatcaatgagaagccacaggtgatccaggagtacgagtcgggcaaggcgattccgaacaatcagataattggaaagctcgagagggcacttggagctaagctgcgtagcaagaagtaatgccttgaaggcaagccctgtcnattgccttacactgcatttgctagtcctaaaagctcctacaggctgtttctgttgggttgatactgaataactatgcacagaacgactttagtatcatanatccctgttcca

SEQ ID NO: 86 - protein, 142 aa, Triticum aestivum
MAGIGPIRQDWEPIVVRKKAQNAADKKDEKAVNAARRSGAEIDTTKKYNAGTNKAASSGTSLNTKRLDDDTENLSHERVSSDLKKNLMQARLDKKMTQAQLAQMINEKPQVIQEYESGKAIPNNQIIGKLERALGAKLRSKK

SEQ ID NO: 87 - DNA, 666 bp, Zea mays
  unsure (10): n is a, c, g or t
  unsure (25): n is a, c, g or t
  unsure (45): n is a, c, g or t
  unsure (53): n is a, c, g or t
  unsure (78): n is a, c, g or t
  unsure (86): n is a, c, g or t
  unsure (120): n is a, c, g or t
  unsure (155): n is a, c, g or t
  unsure (663): n is a, c, g or t
cacaaggaanaacttcaagatgaanatcacatgaaatcactgggnctacaggnctcatcaccaggatatgacaggcangttgttgntgaccatgcaaataatcttgcatctaaaatccgnagcaacttgactaattcaatgaaagctctgggtgnggatatactcactggtattggaaccattgtggggaagcaaaaagtgagatatgggaaagttggtttcccagacaatgaaatcactgctagaaacatcataattgccactggatctgttccttttgtccccaagggcattgaaatagatggtaaaactgtatttactagtgatcatgcactaaaacttgagtcagtccctgaatggattgctattgttggaagtggttacattggacttgaattcagtgatgtatacacagctctaggaagtgaggttacttttgttgaagctcttgatcaattaatgcctgggtttgatcccgagattgcaaaattggcgcagaggattcttattagtcctcgtaaaattgactatcacactggtgtttttgcaagcaagattaccccagcaaaggatggtaagcctgttttgattgagctgattgatgctaaaacaaaagaacacaaggagacacttgaggtggatgcagcactcatagctactggnaag

SEQ ID NO: 88 - protein, 222 aa, Zea mays
  UNSURE (4): Xaa can be any naturally occurring amino acid
  UNSURE (9): Xaa can be any naturally occurring amino acid
  UNSURE (18): Xaa can be any naturally occurring amino acid
  UNSURE (26): Xaa can be any naturally occurring amino acid
  UNSURE (29): Xaa can be any naturally occurring amino acid
  UNSURE (52): Xaa can be any naturally occurring amino acid
HKEXLQDEXHMKSLGLQXSSPGYDRXVVXDHANNLASKIRSNLTNSMKALGXDILTGIGTIVGKQKVRYGKVGFPDNEITARNIIIATGSVPFVPKGIEIDGKTVFTSDHALKLESVPEWIAIVGSGYIGLEFSDVYTALGSEVTFVEALDQLMPGFDPEIAKLAQRILISPRKIDYHTGVFASKITPAKDGKPVLIELIDAKTKEHKETLEVDAALIATGK

SEQ ID NO: 89 - DNA, 979 bp, Zea mays
  unsure (932): n is a, c, g or t
  unsure (935): n is a, c, g or t
  unsure (937): n is a, c, g or t
  unsure (951): n is a, c, g or t
  unsure (958): n is a, c, g or t
cataaacccctcctcgcctcctccgcccgagcctgcctcctcatcgacttatacgcctccttctcttaactcgacgcactagcctcagccaattgtcgcatttcgtcgctatgggtccacagcggccgtctccgtctccgcctcggcgatcgcgtcccgcggctgcgccagatccgaggctgcgcggcggccaggtggaatccgggtctgcggactcggagcgaggccctcacgtgtcactcgcttcggatctcgcaggcgcccgcgaggctgatggtgacgaggccgccgccgccggcggcggcgaccaatggcgcggcggcggggactgcgggttcgactacgatctcgtcatcatcggcgcgggcgtcgggggtcacggcgccgcgctgcacgccgttgaagagggcttaaaaacagcaataattgagggagatgttgtgggtgggacttgtgtaaacagaggctgtgtcccatcgaaagcgcttcttgctgtcagcggtcgaatgcgggagcttcatgatgaacatcatatgaagtctttgggtctacaggtttcctctcctggatatgacagacaagctgttgctgatcatgcaaacaatcttgcctcgaaaatccgtatcaacttgactaactcaatgaaagctctaggagtggatatattgacaggtgttggcactattgtgggaaagcaaaaggtacgatatggaaaagctggtttcccagataaagaaatcactgccaggaacatcataatcgccactggttcagttccttttgttccgaaagggattgagattgatgggaaaactgtatttactagtgatcatgccctgaaacttgaattcagttcccaaactgggatagctttttgttggaaattggttacatttggacttgaatttcattgaattttaccaactcttggnaantnaaggttacttttgnttgaaanctcttgaacaagcttgaatgc

SEQ ID NO: 90 - protein, 250 aa, Zea mays
MGPQRPSPSPPRRSRPAAAPDPRLRGGQVESGSADSERGPHVSLASDLAGAREADGDEAAAAGGGDQWRGGGDCGFDYDLVIIGAGVGGHGAALHAVEEGLKTAIIEGDVVGGTCVNRGCVPSKALLAVSGRMRELHDEHHMKSLGLQVSSPGYDRQAVADHANNLASKIRINLTNSMKALGVDILTGVGTIVGKQKVRYGKAGFPDKEITARNIIIATGSVPFVPKGIEIDGKTVFTSDHALKLEFSSQ

SEQ ID NO: 91 - DNA, 2186 bp, Zea mays
gcacgagcataaacccctcctcgcctcctccgcccgagcctgcctcctcatcgacttatacgcctccttctcttaactcgacgcactagcctcagccaattgtcgcatttcgtcgctatggggtccacagcggccgtctccgtctccgcctcggcgatcgcgtcccgcggctgcgccagatccgaggctgcgcggcggccaggtggaatccgggtctgcggactccggagcgaggtcctcacgtgtcactcgcttcggatctcgcaggcgcccgcgaggctgacggtggcgaggccgccgccgccggcggcggcgaccaatggcgcggcggcggggacctgcgggttcgactacgatctcgtcatcatcggcgcgggcgtcgggggtcacggcgccgcgctgcacgccgttgaagagggcttaaaaacagcaataattgagggagatgttgtgggtgggacttgtgtaaacagaggctgtgtcccatcgaaagcgcttcttgctgtcagcggtcgaatgcgggagcttcatgatgaacatcatatgaagtctttgggtctacaggtttcctctcctggatatgacagacaagctgttgctgatcatgcaaacaatcttgcctcgaaaatccgtatgaacttgactaactcaatgaaagctctaggagtggatatattgacaggtgttggcactattgtgggaaagcaaaaagtacgatatggaaaagctggtttcccagataaagaaatcactgccaggaacatcataattgccactggttcagttccttttgttccgaaagggattgagattgatgggaaaactgtatttactagtgatcatgcactgaaacttgagtcagttccagactggatagctattgttggaagtggttacattggacttgagttcagtgatgtatacacagctcttggaagtgaggttacttttgttgaagctcttgaccagctgatgcctggatttgatcctgaaattgcaaaattagcccagagagttcttatcaatcctcggaaaattgactatcacactggtgtttttgcaagcaagattactcctgcaaaggatgggaaacctgtgctcatcgagcttattgatgcaaagacaaaggagcacaaagaaacccttgaggttgacgcagcccttatagctacaggaagggcgccattcaccaaagggcttggcttggaaaacatcaatgttgttacacaacgtggttttgtgcctgttgatgaacggatgcgagtcatggatgcagatggcaatgtggtacccaatttatattgcattggagatgccaatggcaagctcatgcttgcccatgctgccagtgcacaaggaatttcagttgttgaacaaatctctggaaaggatcacatcctaaatcatttaagcatcccagcagcatgtttcacccatccagagattagtatggttggactgacagagccacaagccagagagaaggcagataaagaaggatttgaggtaaatgttgtgaagactagctttaaggctaacactaaagctttggcagaaaatgaaggagatgggattgctaagttgatttaccgacctgacacgggtgaaattcttggggttcacattttgggtttgcatgctgctgatctcattcacgaggcatcaaatgccatcgccctaggaactcgtgtgcaagacatcaagtttgctgttcacgcacaccctacattgtctgaggtcctggatgaactcttcaaagcagccaaggttaattccggtgtttctcattctgtaaatgaaccagttgcagcctagagaaaggccggatagcaagccaaggcagccaccccaaccactcctgaaggtcctcagcttcgtcacgaccctgttttcttccccaaaacgagattgacaacggtaacggggagggtgttgttgtaggcagttgctgtaggttacaaatttgaggaagaaattcatcagtgaatacaagcacacaaatgtttcttttttgggtccagattgttaaaagggtcttttttttgacggtggggtgggtttttgttggcttcgttatttgcatatttgttgttggttgccctgtaagatgaagtgccgaggctagctcagctagtttgaaataattcatgtttcaaaaaaaaaaaaaaaaaaaaaaaaaaaaaaaa

SEQ ID NO: 92 - protein, 565 aa, Zea mays
MGSTAAVSVSASAIASRGCARSEAARRPGGIRVCGLRSEVLTCHSLRISQAPARLTVARPPPPAAATNGAAAGTCGFDYDLVIIGAGVGGHGAALHAVEEGLKTAIIEGDVVGGTCVNRGCVPSKALLAVSGRMRELHDEHHMKSLGLQVSSPGYDRQAVADHANNLASKIRMNLTNSMKALGVDILTGVGTIVGKQKVRYGKAGFPDKEITARNIIIATGSVPFVPKGIEIDGKTVFTSDHALKLESVPDWIAIVGSGYIGLEFSDVYTALGSEVTFVEALDQLMPGFDPEIAKLAQRVLINPRKIDYHTGVFASKITPAKDGKPVLIELIDAKTKEHKETLEVDAALIATGRAPFTKGLGLENINVVTQRGFVPVDERMRVMDADGNVVPNLYCIGDANGKLMLAHAASAQGISVVEQISGKDHILNHLSIPAACFTHPEISMVGLTEPQAREKADKEGFEVNVVKTSFKANTKALAENEGDGIAKLIYRPDTGEILGVHILGLHAADLIHEASNAIALGTRVQDIKFAVHAHPTLSEVLDELFKAAKVNSGVSHSVNEPVAA

SEQ ID NO: 93 - DNA, 878 bp, Zea mays
  unsure (734): n is a, c, g or t
  unsure (744): n is a, c, g or t
  unsure (819): n is a, c, g or t
  unsure (867): n is a, c, g or t
gattactcctgcaaaggatggaaaacctgtgctcatcgagcttattgatgcaaagacaaaggagcacaaagaaacccttgaggttgacgcagcccttatagctacaggaagggcgccattcaccaaagggcttggcttggaaaacatcaatgttgttacacaacgtggttttgtgcctgttgatgaacggatgcgagtcatggatgcaggtggcaatgtggtacccaatttatattgcattggagatgccaatggcaagctcatgcttgcccatgctgccagtgcacaaggaatttcagttgttgaacaaatctctggaaaggatcacatcctaaatcatttaagcatcccagcagcatgtttcacccatccagagattagtatggttggattgacagagccacaagccagagagaaggcagataaagaaggatttgaggtaaatgttgtgaagactagctttaaggctaacactaaagctttggcagaaaatgaaggagatgggattgctaagttgatttaccgacctgacacgggtgaaattcttggggttcacattttgggtttgcatgctgctgatctcattcacgaggcatcaaatgccatcgccctaggaactcgtgtgcaagacatcaagtttgctgttcacgcacaccctacattgtctgaggtcctggatgaactcttcaaagcagcaagttaattccggtgttctcattctgtaaatgaaccanttcagcctanagaaaggcggtacaagccaaggaagcacccaaacaccctgaagtcccagttctcacgacctgtttctcccaaaanagattgcaacgtacgggaaggtgttgttgtagcagtgcgtagtacaanttgggaaaatc

SEQ ID NO: 94 - protein, 233 aa, Zea mays
ITPAKDGKPVLIELIDAKTKEHKETLEVDAALIATGRAPFTKGLGLENINVVTQRGFVPVDERMRVMDAGGNVVPNLYCIGDANGKLMLAHAASAQGISVVEQISGKDHILNHLSIPAACFTHPEISMVGLTEPQAREKADKEGFEVNVVKTSFKANTKALAENEGDGIAKLIYRPDTGEILGVHILGLHAADLIHEASNAIALGTRVQDIKFAVHAHPTLSEVLDELFKAAS

SEQ ID NO: 95 - DNA, 529 bp, Oryza sativa
  unsure (276): n is a, c, g or t
tgtatccaggtttcaacagctggatatgataggcaggctgttgcagatcatgcaaataatctggcctctaaaattcgtagcaacttgactaattcgatgaaagctttgggtgtggatatattgactggttttggcaccattgtgggaaaacaaaaagtgagatatggaaaagttggttttcctgacaatgaaatcactgccagaaatatcattattgcaacggggtctgttccttttgtccccaatggcatcgaaatagatggaaaatatgtgttngcatatgcacattcactagttcttacagagctcgctgaatggttttatgcaggtaaaaccgtatttactagtgatcatgcactaaaacttgagtcagttcctgactggattgctatcgtgggaagcggttacattggactggaattcagtgatgtatacacggctctgggaagtgaggtggatgcagctctcatagctaccgggaagggcaccgttcaacaaagggcttggcttggaaaagtcaacgtgtaca

SEQ ID NO: 96 - protein, 176 aa, Oryza sativa
  UNSURE (92): Xaa can be any naturally occurring amino acid
CIQVSTAGYDRQAVADHANNLASKIRSNLTNSMKALGVDILTGFGTIVGKQKVRYGKVGFPDNEITARNIIIATGSVPFVPNGIEIDGKYVXAYAHSLVLTELAEWFYAGKTVFTSDHALKLESVPDWIAIVGSGYIGLEFSDVYTALGSEVDAALIATGKGTVQQRAWLGKVNVY

SEQ ID NO: 97 - DNA, 1556 bp, Oryza sativa
  unsure (721): n is a, c, g or t
gcacgagtgtatccaggtttcaacagctggatatgataggcaggctgttgcagatcatgcaaataatctggcctctaaaattcgtagcaacttgactaattcgatgaaagctttgggtgtggatatattgactggttttggcaccattgtgggaaaacaaaaagtgagatatggaaaagttggttttcctgacaatgaaatcactgccagaaatatcattattgcaacggggtctgttccttttgtccccaatggcatcgaaatagatggaaaatatgttaaaaccgtatttactagtgatcatgcactaaaacttgagtcagttcctgactggattgctatcgtgggaagcggttacattggactggaattcagtgatgtatacacggctctgggaagtgaggtggatgcagctctcatagctaccggaagggcaccgttcaccaaagggcttggcttggaaaatgtcaacgttgttacacaacgcggttttgttcctgttgatgagcggatgcaagttatggacgcagatggcaatgcggttccaaatttgtattgtattggagatgccaatggcaaactcatgctggctcatgctgccagtgcacaaggaatctcagttgttgagcgaatctctgggaaagacaacatcctaaatcatctaagcatcccggctgcctgtttcactcatccggagattagtatggttgggctaacaganccacaagcgagagaaaaggctgataaggaaggatttgagataagtgttgttaagaccagcttcaaggcaaacacgaaggctctggctgagaatgaaggagatggacttgctaagatgatttaccggcctgacactggagaaattcttggagttcacatattaggtttgcatgctgctgacctcatccacgaggcatcaaacgccattgccctcggaactcgtgtacaagacatcaagtttgctgttcatgcacacccaactttgtctgaggttctggatgagctcttcaaagctgccaaggttaatgcaggtgttcctcattccgtaaatgagcccgtcgcagcctagagaggaacatcatctgggatagcccccctcttggatgtccttgattcctagttactggcaagtgtaattcggtaattcctgatgagatccaccagttagtgctgagatatctaattactgcggaaaaagagaggaactactgatgagatccaccagttagtgctgagatatctagttaccgcggaaaagagaggaactactgcgtcgttctatgtatgatgtatcacatatacataacagttttgcagcttatgtagagttcatccgtacagtgctttcacatgtcgtcgtcttttcccctgtctaatagtagcttgattagcttgctcagttttctatccgacaaacacctactcttgcttgctttggagcagcatcaacaggccaaggcatgatggaaatgcttctatagttgtggttgaacaggtaagttcaataaacagagcaatgaagttttgaaaggcattcctggagctagtggtggcaa

SEQ ID NO: 98 - protein, 353 aa, Oryza sativa
  UNSURE (238): Xaa can be any naturally occurring amino acid
CIQVSTAGYDRQAVADHANNLASKIRSNLTNSMKALGVDILTGFGTIVGKQKVRYGKVGFPDNEITARNIIIATGSVPFVPNGIEIDGKYVKTVFTSDHALKLESVPDWIAIVGSGYIGLEFSDVYTALGSEVDAALIATGRAPFTKGLGLENVNVVTQRGFVPVDERMQVMDADGNAVPNLYCIGDANGKLMLAHAASAQGISVVERISGKDNILNHLSIPAACFTHPEISMVGLTXPQAREKADKEGFEISVVKTSFKANTKALAENEGDGLAKMIYRPDTGEILGVHILGLHAADLIHEASNAIALGTRVQDIKFAVHAHPTLSEVLDELFKAAKVNAGVPHSVNEPVAA

SEQ ID NO: 99 - DNA, 514 bp, Glycine max
  unsure (456): n is a, c, g or t
  unsure (478): n is a, c, g or t
  unsure (509): n is a, c, g or t
tacacatctccacttcaccattttccatttccctctccctccaaaaatgcattcctcgctctctctctcgttctccgccacttcctcctccgtcgccactgtttccagatcacgccactcattccactctcccgccgccgccatgcctctcaatctccgcttctgcggcttgaggcgcgatgcatttggttcaggtctcgctgcttctctcaaccgctaccactcccacctccctcgccgccctcactccgccgcagtctctgccgcgctatctagcaatggaagccctcccaaatcgtttgactacgatttgctgataatcggcgccggcgttggcggccacggcgccgcgcttcatgccgttgagaagggtttgaaaacagccattgtggaaggagatgtggtgggagggacatgtgtgaacaaaaggctgtgttccttcaaaagctcttttanccgtgagtgggtcgtatgcganaactaaaggagcgattatcacttgaagtccntttgg

SEQ ID NO: 100 - protein, 295 aa, Glycine max
  UNSURE (256): Xaa can be any naturally occurring amino acid
MHSSLSLSFSATSSSVATVSRSRHSFHSPAAAMPLNLRFCGLRRDAFGSGLAASLNRYHSHLPRRPHSAAVSAALSSNGSPPKSFDYDLLIIGAGVGGHGAALHAVEKGLKTAIVEGDVVGGTCVNKGCVPSKALLAVSGRMRELKSDHHLKSFGLQVSAAGYDRQGVADHANNLASKIRNNLTNSMKALGVDILTGFGTILGPQKVKVGSSDKIVTAKDIIIATGSVPFVPKGIEIDGKTVITSDHALKLESVPXLVAIVGSGYIGLGISDVYTALGSEVTFIEALDQLMPGFE

SEQ ID NO: 101 - DNA, 2273 bp, Glycine max
gcacgagtacacatctccacttcaccattttccatttccctctccctccaaaaatgcattcctcgctctctctctcgttctccgccacttcctcctccgtcgccactgtttccagatcacgccactcattccactctcccgccgccgccatgcctctcaatctccgcttctgcggcttgaggcgcgatgcatttggttcaggtctcgctgcttctctcaaccgctaccactcccacctccctcgccgccctcactccgccgcagtctctgccgcgctatctagcaatggaagccctcccaaatcgtttgactacgatttgctgataatcggcgccggcgttggcggccacggcgccgcgcttcatgccgttgagaagggtttgaaaacagccattgtggaaggagatgtggtgggagggacatgtgtgaacagaggctgtgttccttccaaagctcttttagccgtgagtggtcgtatgcgagaactaaggagcgatcatcacttgaagtcctttggcttacaggtttctgctgctggctatgacagacaaggagtcgctgatcatgctaataaccttgcttcgaaaatccgtaataatttgaccaactcaatgaaagcacttggagtagacatacttactggttttggaactattctgggtcctcaaaaggtgaaagttggctcttcagacaaaatagtaactgcaaaaaatatcatcattgctactggttctgttccttttgttcctaagggcattgaaattgatgggaagactgtgattaccagtgaccacgcactcaaactggagtctgttcctgattggatagcaattgtaggaagtggatatattggtcttgaattcagtgatgtatatacagcacttggaagtgaggttacttttatagaagctttagatcaacttatgcctggatttgatcctgaaattagcaagttggctcagagggtccttataaatccccggaatattgactatcatactggagtttttgcaaccaagatcacgcctgcaagggatggaaaacctgtcttgattgaacttattgatgcgaaaaccaaggagccgaaagacacgctggaggtggatgctgcactaatagcaactggaagggctccgttcacacaaggtcttggattggagaatattgatgtggtaacacagcgtggttttgttccagtggatgagcacatgcgagtaattgatgcgaatggcaagctggtgcctcatttatattgtattggtgatgcaaatggcaagatgatgcttgctcatgctgccagtgcacaaggaatttcagtggttgaacaagtcactggaaaagatcacgtgctcaatcatttaagcatcccagctgcttgtttcactcatcctgaacttagcatggttggattaacagagcctcaagcaagggtgaaaggtgaaaaagaggggtttgaagtaagtgttgccaaaacaagttttaaagctaacacaaaggctctagcagaaaacgaaggagagggactagccaagttgatatacagacctgacaatggagagatactaggagttcatatttttggtttgcatgcagcagatctcatccatgaagcatccaatgcaatagcattagggacacatattcaggacataaaatttgccgttcatgcacatccaactttgtccgaggttcttgatgaactattcaaatcagcaaaggttaaagcacaagcttctagcccagtaagtgaaccagttgcagtctaatcttcccaaacaaagtataaaattttgaagaaatttacgtgtactagggacttccaaaatattcatcttcaggaggaacacacaaacacattcagaatcctgtaaaagaggggaaccgtttgagggaaatcaagaatgacctgattatggataaccgccgaagcttacatgtaatggtttcttttctacttgatattcttagcgccagtcaaagatgcttatcttcattattgcattttttaaactatagtcaatgagaaggcctctgacagcggcctatttttttagagtgctactagttttgcaccgaacacgtatgtaccattaaacagttttccttcagagatgatgaaattatgcttgtcgacagacctttgggttcaatacgtaatacgtaaaggttcgaaattgttttgggtggaagttttttcccttaaaaaaaaaaaaaaaaaaaaaaaaaaaaaaaaaaaaaaaaaaaaaaaaaaaaaaaaaaaaaaaaaaaaaaaa

SEQ ID NO: 102 - protein, 570 aa, Glycine max
MHSSLSLSFSATSSSVATVSRSRHSFHSPAAAMPLNLRFCGLRRDAFGSGLAASLNRYHSHLPRRPHSAAVSAALSSNGSPPKSFDYDLLIIGAGVGGHGAALHAVEKGLKTAIVEGDVVGGTCVNRGCVPSKALLAVSGRMRELRSDHHLKSFGLQVSAAGYDRQGVADHANNLASKIRNNLTNSMKALGVDILTGFGTILGPQKVKVGSSDKIVTAKNIIIATGSVPFVPKGIEIDGKTVITSDHALKLESVPDWIAIVGSGYIGLEFSDVYTALGSEVTFIEALDQLMPGFDPEISKLAQRVLINPRNIDYHTGVFATKITPARDGKPVLIELIDAKTKEPKDTLEVDAALIATGRAPFTQGLGLENIDVVTQRGFVPVDEHMRVIDANGKLVPHLYCIGDANGKMMLAHAASAQGISVVEQVTGKDHVLNHLSIPAACFTHPELSMVGLTEPQARVKGEKEGFEVSVAKTSFKANTKALAENEGEGLAKLIYRPDNGEILGVHIFGLHAADLIHEASNAIALGTHIQDIKFAVHAHPTLSEVLDELFKSAKVKAQASSPVSEPVAV

SEQ ID NO: 103 - DNA, 1208 bp, Triticum aestivum
  unsure (932): n is a, c, g or t
  unsure (1043): n is a, c, g or t
  unsure (1080): n is a, c, g or t
  unsure (1114): n is a, c, g or t
  unsure (1142): n is a, c, g or t
  unsure (1160): n is a, c, g or t
  unsure (1163): n is a, c, g or t
  unsure (1168): n is a, c, g or t
  unsure (1177): n is a, c, g or t
  unsure (1196): n is a, c, g or t
  unsure (1203): n is a, c, g or t
  unsure (1206): n is a, c, g or t
gcaaaattgtgggaaagcaaaaggtacgatatggaaaagtaggttttccagaaaaagaaatcactgcaaagaacatcatcattgccactggatcagttccttttgttcccaagggcatagaaattgacggcaagactgtatttactagtgatcatgcattaaaacttgaatcagttccggactggatagctattgttggaagtggttatattggacttgaattcagcgatgtgtacacagctctaggaagcgaggttacctttgttgaagctcttgaccagctgatgcctggttttgatcctgcaatcgcaaaattggctcagagagtccttatcaatccaaggaaaattgactatcacactggtgtttttgcaagcaagattactccggcaaaggatggaaagcctgtgttgattgaactcattgatgccaaaacgaaggaacacaaagaaccttgaggtggatgcagcccttatagccactggaagagcaccattcaccaacggacttggcttggaaaatattaatgttgttacacagcgtgggttttatcctgttgatgagcggatgcaatcaacggatgctgatggcaatgtggtgccgaatttattttgcattggagatgcgaatggtaaactcatgcttgcccatgctgccagtgcacagggaatctcagtcgttgagcaaatctctgggagggaccacattctaaaccatttaagcatcccagctgcttgtttcactcatccagaaatcagtatggttgggctgacagagccgcaagccagagaaaaggctgataacgaaggatttgaagtaagtgttgttaagaccagctttaaggccaacacaaaagctttggcagaaaatgaaggcgacggaattgctaagatgatctaccgacctgacacgggagaattcttgggtgtcanatcttgggtttcatgctgctgactcatcaacaaggatcaaatgcattgccctaggaccgtttgcaagaactaagcttgctgtcatcacaccaacgttgtccgaaatcctcnaacgaactcctcaaagcggcaaggtaatcaagggtcnccatccgtaaataacaattcaactaaagacggangacgcagcaatcatcaaccaaccgtctnaaggtctaattcacacanccngaatnccaacctancataaggactttcaccgcngggcaanaanga

SEQ ID NO: 104 - protein, 308 aa, Triticum aestivum
KIVGKQKVRYGKVGFPEKEITAKNIIIATGSVPFVPKGIEIDGKTVFTSDHALKLESVPDWIAIVGSGYIGLEFSDVYTALGSEVTFVEALDQLMPGFDPAIAKLAQRVLINPRKIDYHTGVFASKITPAKDGKPVLIELIDAKTKEHKNLEVDAALIATGRAPFTNGLGLENINVVTQRGFYPVDERMQSTDADGNVVPNLFCIGDANGKLMLAHAASAQGISVVEQISGRDHILNHLSIPAACFTHPEISMVGLTEPQAREKADNEGFEVSVVKTSFKANTKALAENEGDGIAKMIYRPDTGEFLG

SEQ ID NO: 105 - DNA, 466 bp, Typha latifolia
cttccatcctgcaataaataacccgaccaaatcttttcctctcatccctcatctctaaatcgaacctctaatcaaacaaagaaaagaagcaaaaagatggagagctccttgaagtcggcggcgcttttggagcagatgaagctccacctcaaaaccgacgccggcaaagacatcaccaaaaagatcggcctcgtctaccaactcaacatcgctcccaagaaaattggggtggatgaggagatcttcgtcgtcgatctcaaagaaggcaaagtcaccaaaggtccttacgaagggaagcccgacgccacgttctcgttcacggatagcgatttcctctcaattgcgactgggaagatgaatccgcaaatggcgtttattagaggtgcgatgaagattaagggaagcataggtgcggcaacaaagtttacgccgggatattttcctaagccttcgaagatgtagaaag

SEQ ID NO: 106 - protein, 121 aa, Typha latifolia
MESSLKSAALLEQMKLHLKTDAGKDITKKIGLVYQLNIAPKKIGVDEEIFVVDLKEGKVTKGPYEGKPDATFSFTDSDFLSIATGKMNPQMAFIRGAMKIKGSIGAATKFTPGYFPKPSKM

SEQ ID NO: 107 - DNA, 529 bp, Eucalyptus grandis
  unsure (458): n is a, c, g or t
  unsure (463): n is a, c, g or t
  unsure (475): n is a, c, g or t
  unsure (489): n is a, c, g or t
  unsure (508): n is a, c, g or t
  unsure (516): n is a, c, g or t
caccggcacatccccggtctctccccaagcgattctcgagccgagccggacgcggaagcaagcggccatggcgagcgactcgagcgcgacccagctcaaatccgacgccttgatggagcagatgaagcagcacctctccaccgacgccggcaaggcggtcaccaagaagatcggcctcgtctatcagatcaacatcgcccccaagaaaattgggttcgacgaggtggtctacatcgtcgatctgaagaagggagaggtcactaaaggaccatatgaaggtggaaaacctgatgctaccttttccttcaaagatgatgattttatcaaggttgccactggaaaaatgaatcctcaaattgcttttatgaggggagcaatgaagattaagggaagcctgagtgcagcgcagaaattcactcctgacatattcccaaagccatcgaagatgtgagcatttnaaaangggtcttcaatnctggggttttttangttcctcctggtttccggntgggaaanaaaaagggggaaa

SEQ ID NO: 108 - protein, 127 aa, Eucalyptus tereticornis
MASDSSATQLKSDALMEQMKQHLSTDAGKAVTKKIGLVYQINIAPKKIGFDEVVYIVDLKKGEVTKGPYEGGKPDATFSFKDDDFIKVATGKMNPQIAFMRGAMKIKGSLSAAQKFTPDIFPKPSKM

SEQ ID NO: 109 - DNA, 704 bp, Zea mays
  unsure (640): n is a, c, g or t
  unsure (663): n is a, c, g or t
  unsure (688): n is a, c, g or t
  unsure (692): n is a, c, g or t
  unsure (696): n is a, c, g or t
ggctagatccagatccagatccagcaaccagcatgggccgtggcgtggcgtgcttgcagctgcagtcctgcacgtcttgccgctttgattgccttctccttcccgcaactactcatcctttccatcaaaactgagcaaacccctcatcctattctcgcgcccggcgtctcccttctccaacctccgtttctaatccgcgctgctaatcccactcccagtcccagctcttccgctgagatggacagtagcagcctcaaatccgcgcagctcctggagctgatgcgccagcacctggccaccgatgccggcaaggaggtcaccaagaaggtcggcctcgtctaccagctcaacatcgcccccaagaagatcggcgttgatgaggagatcttcgtggtcgacctcaagaagggcgaggtcaccaaagggccgtaccagggaaagccggatgccactttctccttcacggacaacgatttccttggaatcgccaccggcaagacgaatccgcagattgcattcattcgaggggcgattagatcaaaggggaacatcagtgcggcgcagaagttcaccctgacatcttcccaagctgctaagctgtaaaggttaattgggtaatacttggccaaggggaaaatangtttgaagcttaattacaagtanagatacatgagtggacataaaagangtcncggnggaaattg

SEQ ID NO: 110 - protein, 121 aa, Zea mays
MDSSSLKSAQLLELMRQHLATDAGKEVTKKVGLVYQLNIAPKKIGVDEEIFVVDLKKGEVTKGPYQGKPDATFSFTDNDFLGIATGKTNPQIAFIRGAIRSKGNISAAQKFTLTSSQAAKL

SEQ ID NO: 111 - DNA, 752 bp, Zea mays
gcacgagggcgtgcttgcagctgcagtcctgcacgtcttgccgctttgattgccttctccttcccgcaactactcatcctttccatcaaaactgagcaaacccctcatcctattctcgcgcccggcgtctcccttctccaacctccgtttctaatccgcgctgctaatcccactcccagtcccagctcgtccgctgagatggacagtagcagcctcaaatccgcgcagctcctggagctgatgcgccagcacctggccaccgatgccggcaaggaggtcaccaagaaggtcggcctcgtctaccagctcaacatcgcccccaagaagatcggcgttgatgaggagatcttcgtggtcgacctcaagaagggcgaggtcaccaaagggccgtaccagggaaagccggatgccactttctccttcacggacaacgatttccttggaatcgccaccggcaagacgaatccgcagattgcattcattcgaggggcgattaaaatcaaggggagcatcagtgcggcgcagaagttcacccctgacatcttccccaagcctgctaagctgtagaaggttagattgtgtattacttggtcgaggtgaataataatgtttgcaagcttcaattactatgtacgagatacaatgagtggaacatgaaaagcacgttctcggtgggaatttggatatggttgaacttccacttaaatcaagctcaatgttcgtttctcatgattaaaaaaaaaaaaaaaaaa

SEQ ID NO: 112 - protein, 122 aa, Zea mays
MDSSSLKSAQLLELMRQHLATDAGKEVTKKVGLVYQLNIAPKKIGVDEEIFVVDLKKGEVTKGPYQGKPDATFSFTDNDFLGIATGKTNPQIAFIRGAIKIKGSISAAQKFTPDIFPKPAKL

SEQ ID NO: 113 - DNA, 461 bp, Hevea brasiliensis
taccctcacctgacctccatatcaaattcaaatgctccaatcttccttgtaacactagaatttacactcttgttaagatcaatggctgcggagctcaagtctgaatccgtttttgatctcctcaagcgattcctcgagaccgacgagggtattgaacttagaaagaagatcaaccttgtctatcagttcaatatcgcccccaagaaaattgggatagatgaggtgtcatatactgttaatctcaagaaaggagaggttaataaaggcccatatgaaggaggcaagcctgatgccacattttccctcaaggatgaagattttgtcaagcttgctgagggaaaattgaatccccaaattgctttcatgaggggcactttgaagattaagggcaacctgagtgcagcgcaaaaattcactcctgacatcttcccaaagccgtcaaagctttgaagctattttag

SEQ ID NO: 114 - protein, 122 aa, Hevea brasiliensis
MAAELKSESVFDLLKRFLETDEGIELRKKINLVYQFNIAPKKIGIDEVSYTVNLKKGEVNKGPYEGGKPDATFSLKDEDFVKLAEGKLNPQIAFMRGTLKIKGNLSAAQKFTPDIFPKPSKL

SEQ ID NO: 115 - DNA, 626 bp, Oryza sativa
  unsure (493): n is a, c, g or t
  unsure (578): n is a, c, g or t
  unsure (582): n is a, c, g or t
  unsure (590): n is a, c, g or t
  unsure (592): n is a, c, g or t
  unsure (602)..(603): n is a, c, g or t
  unsure (614)..(615): n is a, c, g or t
  unsure (619): n is a, c, g or t
gccacttccccacaacgaggagaggaacagcagagcaaagccccacctcctcccctcctgcgcatctcctctcctccccggaatctgctctccgccgccgccgcccggcagaggagatggacggcagcagcctcaagtcggcgcagctcctcgagcagatgcgcctccacatggccaccgacgccggcaaggacatcgccaagaaggtcggcctcgtctaccagttcaacatcgcccccaagaaaatcggagtcgacgaggagatcttcgtcgtcgacctcaagaagggcgaggtcaccaaagggccgtacgaggggaagccagatgcgaccttctccttcacggattctgatttcctctcgatcgccacggggaagatgaacccacagatcgcgttcattcgaggcgcgataaagatcaaggggagcataagcgcggcgcaaaagttcaccccggatatcttccccaagccttccaaactgtagaaggttanaggtatattgtttgggcgaggttggtaataataaggggtttgctagttgcaatactgtgtttgatagaatgggggggagaaaaantggnaacaaggnanaacacacganntgcctggatgnnaatngcctggg

SEQ ID NO: 116 - protein, 122 aa, Oryza sativa
MDGSSLKSAQLLEQMRLHMATDAGKDIAKKVGLVYQFNIAPKKIGVDEEIFVVDLKKGEVTKGPYEGKPDATFSFTDSDFLSIATGKMNPQIAFIRGAIKIKGSISAAQKFTPDIFPKPSKL

SEQ ID NO: 117 - DNA, 547 bp, Glycine max
  unsure (454): n is a, c, g or t
  unsure (457): n is a, c, g or t
  unsure (492): n is a, c, g or t
  unsure (506)..(507): n is a, c, g or t
  unsure (522)..(523): n is a, c, g or t
  unsure (529): n is a, c, g or t
ccaaactgttaggtttcctttgtttggtgtgaagccatggctgattcttcttccaacctgaaatccgacgcgataatggagcagatgaagcaacacctcgccaccgacgctggcaaacaagtcaccaataaaattggactcgtttatcagtttcacattgctcctaagaaacttggattcgacgaggtcgtctacaccgttgatctcaagaaaggagaggtcaccaaagggtcatatgaaggaggaaagcctgatgcatctttttcgtttaaggatgaggactttgttaaggttgccttagggaagatgaatccgcagattgctttcatgaggggtgcgatgaagattaagggaagtttgagtgctgctcagaaatttactccggatatcttcccaaagccttctaagctgtgagctgagatttctgcaaactacctgcacaaagggttgctanaantatcctttggctgcaagtcaaacaaaaattagatnagcaatcatagtannatcaaaagctgaagnntaaaantaaatccttaagttaatg

SEQ ID NO: 118 - protein, 125 aa, Glycine max
MADSSSNLKSDAIMEQMKQHLATDSGKQVTKKIGLVYQIQIAPKKLGIDEVVYTVDLRKGEVTKGPYEGGKPDASFSFKDEDFVKVALGKMNPQIAFMRGAMKIKGSLSAAQKFTPDIFPKPSKL

SEQ ID NO: 119 - DNA, 531 bp, Vernonia mespilifolia
  unsure (422): n is a, c, g or t
  unsure (528): n is a, c, g or t
tttactcctaaaaccacctccatctccgccgacccgatggcatcgtctgatctgaaatccgccgccttgatggagcagatgaacacccatttctccaccgacgccggcaaagctctcaccaaaaagatcggccttgtttatcaaatcaatatcgctcccaagaaacttggattcaacgaagagatttacgttgtcgatttgaagaaaggagaggttacaaaaggcccatatgaaggaggaaaaccagatgccactttttctttcacagatgaggatttcttcaagattgctacagggaaaatgaatcctcaaattgctttcatgaggggtaaaatgaaggtgaagggaagtttgagtgcagcccagaaatttacaccaagaatctttcctaaaccctcaaagatgtaagctctaaaattggnttatttgaattggtggcatcatcaatgttaaagctagtgatgaattgataaattatcaacattttttaataagtttgtgatggtaatgatacattgttgcatgtanttt

SEQ ID NO: 120 - protein, 123 aa, Vernonia mespilifolia
MASSDLKSAALMEQMNTHFSTDAGKALTKKIGLVYQINIAPKKLGFNEEIYVVDLKKGEVTKGPYEGGKPDATFSFTDEDFFKIATGKMNPQIAFMRGKMKVKGSLSAAQKFTPRIFPKPSKM

SEQ ID NO: 121 - DNA, 472 bp, Triticum aestivum
  unsure (218): n is a, c, g or t
  unsure (232): n is a, c, g or t
  unsure (367): n is a, c, g or t
  unsure (431): n is a, c, g or t
ctcgtgccgaattcggcacgagcaaaaacgataaatttccctcctccgctgcatttgatgcaatcaataactctttcaagagctcagaggctgaccgaatcaaggccatcaaagaagccaagtcggtcttcgccttcaccctgaagaacaaggctggtgaaactgagagctggcatattgacctactgaaaaagggtgaggtggggaagggacttggngaatctcccacagncactctcaagatgtcggacgaagattttggcagattagtcaacgctactgaagacccacagaagttatttatgtcaggtagactaggggttgagggagatataatgaaggcaaccaaattgcggaatttattcanaaaatctcagcggtcaagtcaaaagttataatatgttgtcaaaataatttattcgggccgtagntaatttttaatacgattaagtgggctttcctcaagaaaaaa

SEQ ID NO: 122 - protein, 131 aa, Triticum aestivum
  UNSURE (77): Xaa can be any naturally occurring amino acid
  UNSURE (122): Xaa can be any naturally occurring amino acid
RAEFGTSKNDKFPSSAAFDAINNSFKSSEADRIKAIKEAKSVFAFTLKNKAGETESWHIDLLKKGEVGKGLGESPTXTLKMSDEDFGRLVNATEDPQKLFMSGRLGVEGDIMKATKLRNLFXKSQRSSQKL

SEQ ID NO: 123 - DNA, 642 bp, Triticum aestivum
  unsure (34): n is a, c, g or t
  unsure (624): n is a, c, g or t
ctcgtgccgaattcggcacgagcccagccgaggngactcccgtacctgcacgtctcccctcccctcccctcccatccccggtggttggagccattatagagagggcgaggagcatcatctcctacagtcccaagatccaaccccatctccagcctgccccctcccccagtccccaaatccgtagtcccgcgcgccgcgatggaggcgagcaagctcaaggcggccaggctcctggagcagatgagcgcccacctcgccaccgacgccggcaaggagatcgccaacaaggtcggcttcgtctaccagctcaacatctcgcccaagaagatgggcgtggacgaggagatcttcgtcgtggacctcaagaagggcgccgtctccacagggaagtacgaggggacgccggacgcggccttcaccttcaccgacgacgacttcctcgccatcgccagcggcaagctgaacccgcagatggcgtttataaggggcaagctgaagatcaaggggagcatcagcgccgcgcagaagttcacgccggacatcttccccaagccgtccaagttgtagaacgccggattgccgtgccttgcccagtgatcggttataaaagatcagttatgctcncgatggaaatttggtgtg

SEQ ID NO: 124 - protein, 122 aa, Triticum aestivum
MEASKLKAARLLEQMSAHLATDAGKEIANKVGFVYQLNISPKKMGVDEEIFVVDLKKGAVSTGKYEGTPDAAFTFTDDDFLAIASGKLNPQMAFIRGKLKIKGSISAAQKFTPDIFPKPSKL

SEQ ID NO: 125 - DNA, 766 bp, Picramnia pentandra
gcacgagaggaaacgaaaaagaatccgagccaaatatagtgatggcggagtcaagtcagctaaaatctgatgctctgttggagcagatgaagaagcacctttcctctgacgccggcaaggatctcattgagaagatcggtcttgtctatcagatcaatatcgctcccaagaaaatcggatacgatgaggttgtctatgtcgttaaccttaagaaaggagacgttaccaaagggccatatgaaggtggaaagcctgatgccaccttttccttcaaggatgatgattttgttaaggttgccactggcaagatgaatcctcagatggctttcatgaggggtgccatgaagattaagggcagtatgactgcagctcagaagtttactcctgaaattttccctaagccctcgaagatgtgagcacaattcttacagaactgcctcacacaatgctgtttcagttgctatttattccaggccaaagtttaaattatgtattaggaaagtaaaaatcatcataaggtcaccaacattattttctgttggtttatggataatctttatgtagtttccaaaagaagttctaatcacaaacttgagaattcaatccaccctagttcattcataattgcataggcgatatgtaaatttgaatatttggttgttggaaaactgtctttcaagtgtaatgtttcgcaatgctcctttgttaatgaatgcggactgcttgttaaattgtgtaaaaaaaaaaaaaaaaaaaaaaaaaaaaa

SEQ ID NO: 126 - protein, 124 aa, Picramnia pentandra
MAESSQLKSDALLEQMKKHLSSDAGKDLIEKIGLVYQINIAPKKIGYDEVVYVVNLKKGDVTKGPYEGGKPDATFSFKDDDFVKVATGKMNPQMAFMRGAMKIKGSMTAAQKFTPEIFPKPSKM

SEQ ID NO: 127 - DNA, 880 bp, Zea mays
gcacgagcacgcgctgctttcagatatctcaccggaccgtcgtcgtcggcccctccgagaacataccaccgcgcccgccgccgcgcgcgccaccacgtccacgtacgccggccggccaccaagcaagcatggatacggtttcacagtccgagcacctgtgctacgtccgctgcacctactgcaacaccgtgctcgcggttggggttccatgcaagaggctcatggacacggtgactgtcaagtgcggccactgcaacaacctctcctacctcagtccacggccccccatggtgcagccgctctcgccgactgatcatcccttggggccattccagtgtcagggaccctgcagtgagtgcaggaggaaccaaccgctgccgctggcctcgccgacatcgactgacctcaccccgagaatgcccttcgttgtcaagcccccggagaagaaacatcgcctcccatctgcttacaatcgcttcatgagggaggagattcagcgcatcaaagctgcgaagccagatatccctcacagggaggccttcagcatggctgccaagaattgggcgaagtgtgacccgcgctgctcgacgactgcctctactgccacttctaacagcgctcctgagcctgctagagtcgtcgtgcccactcctcatgtaactgagccacgctttgatctggaggatagggccaaggagcatgtcattgagagcttcgacatcttcaagcagattgagcgcaacatctagatgtctccatttcgagtaccatcagctctatatataacctatgcatgcatatgcatccccatcttgtactttttacccccatgttactgttgctattattcttgctcttgttggattgtacgcacccttta

SEQ ID NO: 128 - protein, 206 aa, Zea mays
MDTVSQSEHLCYVRCTYCNTVLAVGVPCKRLMDTVTVKCGHCNNLSYLSPRPPMVQPLSPTDHPLGPFQCQGPCSECRRNQPLPLASPTSTDLTPRMPFVVKPPEKKHRLPSAYNRFMREEIQRIKAAKPDIPHREAFSMAAKNWAKCDPRCSTTASTATSNSAPEPARVVVPTPHVTEPRFDLEDRAKEHVIESFDIFKQIERNI

SEQ ID NO: 129 - DNA, 1001 bp, Zea mays
gcacgagcacacagctagcagacagccagacacgcgctgctttctgatctctccccggatcggaggctcctcccaacataccaccctgccagccgcgccgccacgtccacgccggccggccaccaagcaagcatggatatggtttcgcagtccgagcacctgtgctacgtccgctgcacctactgcaacaccgtgctcgcggttggggttccatgcaagaggctgatggacacggtgactgtcaagtgcggccactgcaacaacctctcctacctcagtccacggccccccatggtgcagccgctctcgccgactgatcaccctttggggccattccagtgtcagggaccctgcaacgactgcaggaggaaccaaccgctgccgctggcttcgccgtcatcaactgagctaagcccgagaatgcccttcgtagtcaagcccccggagaagaaacaccgcctcccatctgcttataatcgcttcatgagggaggagattcagcgcatcaaagctgcgaagccagatatccctcacagggaggccttcagcatggctgccaagaattgggcaaagtgtgacccgcgctgctcgacggctgcctctaccgaaacttctaacagcgctcctgctgagcctagagttgtgcccactccccagttaactgagccacgctttgacctggaggatagggccaaggggcaagtcattgagagcttcgacatcttcaagcatattgagcgcagcatctagaggtcgttcgatgccgctgttgtagcccagtatcgatcgagtaccatcagctatatgtataacctatcccgtatcgccgtcgtcgcctcgcaatcatgcatccccatcctgtacttttacccccgtacgtgttactgttgctgttattctcgttatggttggattgtacgcaccatttaattatgaacagctgctacctatatatataatatttgccttcttttttgttcctaaaaaaaaaaaaaaaaaaa

SEQ ID NO: 130 - protein, 205 aa, Zea mays
MDMVSQSEHLCYVRCTYCNTVLAVGVPCKRLMDTVTVKCGHCNNLSYLSPRPPMVQPLSPTDHPLGPFQCQGPCNDCRRNQPLPLASPSSTELSPRMPFVVKPPEKKHRLPSAYNRFMREEIQRIKAAKPDIPHREAFSMAAKNWAKCDPRCSTAASTETSNSAPAEPRVVPTPQLTEPRFDLEDRAKGQVIESFDIFKHIERSI

SEQ ID NO: 131 - DNA, 446 bp, Zea mays
  unsure (396): n is a, c, g or t
  unsure (413): n is a, c, g or t
  unsure (428): n is a, c, g or t
  unsure (445): n is a, c, g or t
aaacaatcagccacaagtgccaccaatacgaccctcagagaagagacagcgtgttccatcagcatacaacagattcatcaaggaagaaatacaaaggataaagacgagcaacccagagattagccacagggaagcattcagtgctgcagcaaagaattgggctcatctccctcggctccatttcggcctcagcgtcgctgacggcggcggcggcagcaactagggaagacgatgattacggatcgagctcttcgccttacacatatatatatgcagtgtgctatgtctgcttggattttgtaagccttattaagttttttgacacctgtgtttcagacctgtgcgtacttgcatgcatgatcctgcattgcgtgcagtaattacatgttggatctnatatgtatatgcatcangggtcacattctaantaatggaaatttgtcang

SEQ ID NO: 132 - protein, 73 aa, Zea mays
NNQPQVPPIRPSEKRQRVPSAYNRFIKEEIQRIKTSNPEISHREAFSAAAKNWAHLPRLHFGLSVADGGGGSN

SEQ ID NO: 133 - DNA, 894 bp, Zea mays
cctttcctcctcccccctgaccccggccattcagacgacgacgaagacagcgccgagaagatctcgccttcacaacaacgacgaacagcgggtacgtacttggagatccaagaagctaagaaatgtcagcccagtttgcatccgagcatgcttgctatgtcaactgcaactattgcaacactatcctggtggtgaatgtgccaagcagttgttcctacaacgtggtgactgttaaatgtgggcattgtacaatggtgctgtccatggatctcagtcccttccatcagcaggcacgcactgtcccagacaaccaggttgtccagaacagagggtttcagtataacaattttgggagctacgagcaagcctcgtcaagaaatctacgaacgcctcccatgtatccagtgtcaaacaatcagccacaagtgccaccaatacgaccctcagagaagagacagcgtgttccatcagcatacaacagattcatcaaggaagaaatacaaaggataaagacgagcaacccagagattagccacagggaagcattcagtgctgcagcaaagaattgggctcatctccctcggctccatttcggcctcagcgtcgctgacggcggcggcggcagcaactagggaagacgatgattacggatcgagctcttcgccttacacatatatatatgcagtgtgctatgtcgtgcttggattttgtaagccttattaagttttttgacaacctgtgttttcagacctgttgcgtacttgcatgcatgaatcctgcattgcgtgcagtaattaacatgtttgatgctatatatgatatatgcatgcatggtgtacaacattactaaataaatggaaaatatttgttcaagaaaaaaaaaaaaaaaaaaaa

SEQ ID NO: 134 - protein, 169 aa, Zea mays
MSAQFASEHACYVNCNYCNTILVVNVPSSCSYNVVTVKCGHCTMVLSMDLSPFHQQARTVPDNQVVQNRGFQYNNFGSYEQASSRNLRTPPMYPVSNNQPQVPPIRPSEKRQRVPSAYNRFIKEEIQRIKTSNPEISHREAFSAAAKNWAHLPRLHFGLSVADGGGGSN

SEQ ID NO: 135 - DNA, 596 bp, Zea mays
  unsure (517): n is a, c, g or t
  unsure (524): n is a, c, g or t
  unsure (534): n is a, c, g or t
  unsure (536): n is a, c, g or t
  unsure (542): n is a, c, g or t
  unsure (546): n is a, c, g or t
  unsure (548): n is a, c, g or t
  unsure (558): n is a, c, g or t
  unsure (561): n is a, c, g or t
  unsure (563): n is a, c, g or t
  unsure (576): n is a, c, g or t
aggttgttgatgtaggctgtacgcacctgctggtttgctactcgatcctatatatcgtccaatcctatctgacctctcgacatctggtccttgattactcgtcctttttgcttggtgcctgtgtatatcgtcgccccggccgcttgagctagcttcctctagtgctcgctctcgtcgtcgatcggttgtttgcatagcccacggcgagccgaagcaatgtcgtcggcgcccctgcagatcgcgccggtgccggagcatgtgtgctacgtgcactgcaacttctgcaacacaattctcgcggtcagtgtcccgagtcacagcatgctgaacatcgtcacagtccgttgtgggcactgcactaacctgctgtcggtgaacttgagaagactcatccaatcacttcctgtccaaaaccaccactactcccagcaacaagagaattcaaccgtccaaaatatgggttttaccggaaaataccctgaataccacttcggtaccgcatgcaaacgaccgtcancgaaagngatctgggtnanaagcgnactncncgggtcaaanacngngattttgtgagantacataaatctaagataaat

SEQ ID NO: 136 - protein, 90 aa, Zea mays
MSSAPLQIAPVPEHVCYVHCNFCNTILAVSVPSHSMLNIVTVRCGHCTNLLSVNLRRLIQSLPVQNHHYSQQQENSTVQNMGFTGKYPEY

SEQ ID NO: 137 - DNA, 1005 bp, Zea mays
gcacgagaggttgttgatgtaggctgtacgcacctgctggtttgctactcgatcctatatatcgtccaatcctatctgacctctcgacatctggtccttgattactcgtcctttttgcttggtgcctgtgtatatcgtcgccccggccgcttgagctagcttcctctagtgctcgctctcgtcgtcgatcggttgtttgcatagcccacggcgagccgaagcaatgtcgtcggcgcccctgcagatcgcgccggtgccggagcatgtgtgctacgtgcactgcaacttctgcaacacaattctcgcggtcagtgtcccgagtcacagcatgctgaacatcgtcacagtccgttgtgggcactgcactagcctgctgtcggtgaacttgagaggactcatccaatcacttcctgtccagaaccaccactactcccagcagcaggagaatttcaccgtccaaaatatgggttttactgaaaattaccctgagtacgcaccttcgtaccgcatgccaacgacgctgtcagcgaaaggtgatctggatcatatgctgcacgtgcgcgggtcaaatgactgtggattttttgtgatgagttacatgaagtcttatgatcacaatgcaggtgtcatatcttctttcaatcaaccagacaattcccgagacctacgtgctcatgcccttcatcaactcacattccatcgcatcaacaaggtgttgccacttccattagatatccagagatttatgtttgcgcgcaattagtgaaatatgtcagaactaagcaatggtgtgggcaatgtaccgtactgtggtattttggccattattgtcagttaacaattgtaggaagcttccttatatgtgctgtttcagaacaattgtcatgctactttgtcttaggggtgttacccaggttctttctgtgaactttagttggctggatacttatggttatgttgcgaatatgtgaacatcatatgttttcaaaaaaaaaaaaaaaaaaa

SEQ ID NO: 138 - protein, 179 aa, Zea mays
MSSAPLQIAPVPEHVCYVHCNFCNTILAVSVPSHSMLNIVTVRCGHCTSLLSVNLRGLIQSLPVQNHHYSQQQENFTVQNMGFTENYPEYAPSYRMPTTLSAKGDLDHMLHVRGSNDCGFFVMSYMKSYDHNAGVISSFNQPDNSRDLRAHALHQLTFHRINKVLPLPLDIQRFMFARN

SEQ ID NO: 139 - DNA, 1041 bp, Zea mays
  unsure (1028): n is a, c, g or t
  unsure (1033)..(1034): n is a, c, g or t
  unsure (1038): n is a, c, g or t
gtggtggaccggagctagtagctgccagccacacatttcggtcgtcggaaccacatatcatgatgtcgtcctcgtcctcgtcctcgtcgtcggccgcctgctgcttcccgctggaccacctcgcgccgtcccccaccgagcagctctgctacgtgcactgcaactgctgcgacaccatcctcgccgtcggcgtgccttgcagcagcctgttcaagacggtgacggtgcgtttgtggcactgcgccaacctactctccgtcaacctcccgcggctcctgtcccgccgccgcgccggcgccgcccaacatctcaacttcgctcactccttgctgtcacccacatccccgcatggcctcttggacgagttggctctccagcaggcgccgagcttcctgatggagcaggcgagtgccaacctgagcagcaccatgacgggccgcagcagcaacagcagctgcgccagcaacctgccgccgccggcgccgatgcctgcagctcagcctgtgcagcaggaagccgaactgcccaagaccgccccgtcggtaaacaggcctccggagaagaggcagcgcgtgccgtcggcgtacaaccgcttcatcaaggacgaaatccaacgcatcaaggctggcaatcccgacatctcgcacagggaggccttcagcgcggcggccaagaactgggcgcactttccacacatccactttggactcatgccagatcaccaggggcccaagaagacaagcctgctacctcaggatcaccagagaagcgacggcggcgggctactaaaggaagggctgtacgctgcggcagccaacatgggggttgctccatactaatataataataatcactcctacttacgtgctcaagcttataatattagagtagcaaagctgctacgtactgttagggctctatggactactacgaagctatggacgtgtttggtaggctgcatatgggccggccaggctggtaagatacagcgtacgcttgtttggttgctaaaaaaaaaaaaaaagggngggcnntttnaag

SEQ ID NO: 140 - protein, 261 aa, Zea mays
MMSSSSSSSSSAACCFPLDHLAPSPTEQLCYVHCNCCDTILAVGVPCSSLFKTVTVRCGHCANLLSVNLRGLLLPPAAPAPPNHLNFAHSLLSPTSPHGLLDELALQQAPSFLMEQASANLSSTMTGRSSNSSCASNLPPPAPMPAAQPVQQEAELPKTAPSVNRPPEKRQRVPSAYNRFIKDEIQRIKAGNPDITHREAFSAAAKNWAHFPHIHFGLMPDQGLKKTFKTHQDGAEDMLLKDDLYAAAAAAAAANMGITPF

SEQ ID NO: 141 - DNA, 2113 bp, Zea mays
gcacgaggtggtggaccggagctagtagctgccagccacacatttcggtcgtcggaaccacatatcatgatgtcgtcctcgtcctcgtcctcgtcgtcggccgcctgctgcttcccgctggaccacctcgcgccgtcccccaccgagcagctctgctacgtgcactgcaactgctgcgacaccatcctcgccgtcggcgtgccttgcagcagcctgttcaagacggtgacggtgcgttgtggccactgcgccaacctactctccgtcaacctccgcggcctcctgctcccgcccgccgcgccggcgccgcccaaccatctcaacttcgctcactccttgctgtcacccacatccccgcatggcctcttggacgagttggctctccagcaggcgccgagcttcctgatggagcaggcgagtgccaacctgagcagcaccatgacgggccgcagcagcaacagcagctgcgccagcaacctgccgccgccggcgccgatgcctgcagctcagcctgtgcagcaggaagccgaactgcccaagaccgccccgtcggtaaacaggcctccggagaagcggcagagagtcccgtcggcatacaaccggttcatcaaggacgagatccagcgcatcaaggccggcaacccggacatcacccaccgggaggcgttcagcgcagccgcaaagaattgggcccatttcccacacatccacttcggcctcatgccggaccagggcctcaagaagaccttcaagactcatcaggatggcgctgaagacatgctactcaaagacgatctctacgccgcagcggctgcagctgcagcagccaacatgggcatcactccattctaataactctgtgtggggatagaaatggagaataatcaagttagagcgcgcatcaagtaggccactgatgatccgtaggtacagacttgattgtctcctctatatatcccttttcatttcatgttctctctctttttcctattttttgttcctggaccccttcaactcgccagtagagagctcgttgtgcctctccaatcccatgtttgcgtatgtctgctcaacaacatgtttttaccatggagaacaagttgaacatctgttagatctatcaagagtgtcatatataaaaaaaaaaaaaaaaaactcgagcacaagtttcgtgggtagaggaggcactagatactgtgccagatcggggtctggtagtggcagttgggtgattacgacggagtgggatgggcctcctcgacaagctgtgggacgacaccgtcgcgggcccgcgcccggacaccggcctcggccgcctccgcaagcagcccgcgcgccccgccgccgttaagatcagtgatccggccggggacgctgcagcgctcgtgccgccctcgccggcttcgggtagcgaggagacgccggtgaaggtgacgcgcagcatcatgatcaagcgtcccgcggggtacccgtcttcgccgaggagcgcggcaagcacgccgccggcctctccactagggactaccccgcccatctcgccgtttgccggcgctggtggtcgcttcagaaggaaatcatcatccgacgcatatgagagggcaacccctccagggacgaccagccaccctcctcccttcgaagtgtgaaccggctgcaccctcacacttgttttgctccttgacaagcatctcttcacctataataaggtagaggcagggaggagagaagacgacatcaagaggggaacggggatgagttgcgggtttacctctgctgtgatatattgtaggtgccactatgtgtattgttcccccctatctactacgtggcataggttgtattctagtatgttgaaagctcatggtgccgtgctgtatcaataaggtgttatgcgcatagagtggctcaggaccagggctgcgtttgcgctttgccactggctgtgttgtatgtttcttctgctgctatgccattagggtttagggatggtgtgtggatggcgtcgtgcttgtagtgttagctgggtttgaagcggactacatgtaggtttgttcaatgtctggtatctattagctgaaggtgtttgcctgtaaaaaaaaaaaaaaaaaaaaaa

SEQ ID NO: 142 - protein, 261 aa, Zea mays; identical to SEQ ID NO: 140

SEQ ID NO: 143 - DNA, 1206 bp, Zea mays
ccacgcgtccggcatttcccctctctccagcacattgctgcttccacagttccacacacataaggccaccacagcaaataaaggcactgctgcactctctctctctctctctctctctctctctctctacgcgaaaagaaaagaggaaagtgggatagctcaatctctccttccaccgtctctcagttctcactctagcgctctctctctccacatatatatcagtaggatggatgtgcaaacctagcttgttgctgcctttctagctgagaactgagctgtagctgttggtacggttttcctcctcgctcttcttctccttcttcttgctgctggttgccgggagctgagatcgatcgagagcactgctgttgttcgtgcggccggaggcggcggcgcgcggcagggggcggagacgacgaccgatcggtcagaaggaatgtcgtcggcccaaatcgcgccggcggaccatgtgtgctatgtgcactgcaacttctgcaacacagttctcgcggtgagtgtcccggggaacagcatgctcagcatggtgacagttcggtgtgggcactgcacaaatctactgtcagtgaatctgagagcactcatgcactcagtcccagaacaagatcagctccaggagaacatcagggtccatggcacgttgcgtgagcatcatcagtgcggcggcggccaccatctggagctgggctcttcgtcgtcctcaaggttccggctgccgatgatgatgtcgtacgcgccgcagaacgagcacttgctgcaggaacagacactgaacaacgctcgtccggctcctgagaagaggcagcgggttccgtcggcgtataacagattcatcaaggaagagattcgcaggatcaaggcgaacaaccccgacattagccacagggaagccttcagcacagcagccaagaactgggcacattatccgaacatccatttcggcttaaactccggccgagagggtggcaagaataagctcgtggacgaggctgtcgcggcggtggcggtggctccgaagaagatccaaggtttctactgatcgatgccggtcgatcgagggatcagcgctcgtcgtcatcaactggccggccgggtgtggaagaattaataataccacacaaattataaatgtactgtgatgagtaaattaaagagttatagtggggaatgaagggagagagtgtt

SEQ ID NO: 144 - protein, 206 aa, Zea mays
MSSAQIAPADHVCYVHCNFCNTVLAVSVPGNSMLSMVTVRCGHCTNLLSVNLRALMHSVPEQDQLQENIRVHGTLREHHQCGGGHHLELGSSSSSRFRLPMMMSYAPQNEHLLQEQTLNNARPAPEKRQRVPSAYNRFIKEEIRRIKANNPDISHREAFSTAAKNWAHYPNIHFGLNSGREGGKNKLVDEAVAAVAVAPKKIQGFY

SEQ ID NO: 145 - DNA, 1416 bp, Zea mays
ccacgcgtccggcatttcccctctctccagcacattgctgcttccacagttccacacacataaggccaccacagcaaataaaggcactgctgcactctctctctctctctctctctctctctctctctacgcgaaaagaaaagaggaaagtgggatagctcaatctctccttccaccgtctctcagttctcactctagcgctctctctctccacatatatatcagtaggatggatgtgcaaacctagcttgttgctgcctttctagctgagaactgagctgtagctgttggtacggttttcctcctcgctcttcttctccttcttcttgctgctggttgccgggagctgagatcgatcgagagcactgctgttgttcgtgcggccggaggcggcggcgcgcggcagggggcggagacgacgaccgatcggtcagaaggaatgtcgtcggcccaaatcgcgccggcggaccatgtgtgctatgtgcactgcaacttctgcaacacagttctcgcggtgagtgtcccggggaacagcatgctcagcatggtgacagttcggtgtgggcactgcacaaatctactgtcagtgaatctgagagcactcatgcactcagtcccagaacaagatcagctccaggagaacatcagggtccatggcacgttgcgtgagcatcatcagtgcggcggcggccaccatctggagctgggctcttcgtcgtcctcaaggttccggctgccgatgatgatgtcgtacgcgccgcagaacgagcacttgctgcaggaacagacactgaacaacgctcgtccggctcctgagaagaggcagcgggttccgtcggcgtataacagattcatcaaggaagagattcgcaggatcaaggcgaacaaccccgacattagccacagggaagccttcagcacagcagccaagaactgggcacattatccgaacatccatttcggcttaaactccggccgagagggtggcaagaataagctcgtggacgaggctgtcgcggcggtggcggtggctccgaagaagatccaaggtttctactgatcgatgccggtcgatcgagggatcagcgctcgtcgtcatcaactggccggccgggtgtggaagaattaataataccacacaaattataaatgtactgtgatgagtaaattaaagagttatagtggggaatgaagggagagagagatatatagcaatacgtatattaccttaccttattaatgagtgcaaaaaaaacacttgtgaaggtttctactgatgcatgagtgggaagtgaagcatcatacaatcacatgaattatattactactggcatggtgggcgccatgcatggtttaaattaaccgagaagacgacttaataaatcattatttgacctaaaaaaaaaaaaaaaaaag

SEQ ID NO: 146 - protein, 206 aa, Zea mays; identical to SEQ ID NO: 144

SEQ ID NO: 147 - DNA, 1038 bp, Zea mays
  unsure (936): n is a, c, g or t
  unsure (960): n is a, c, g or t
  unsure (962): n is a, c, g or t
  unsure (981): n is a, c, g or t
  unsure (995): n is a, c, g or t
  unsure (1003)..(1004): n is a, c, g or t
  unsure (1007): n is a, c, g or t
  unsure (1015): n is a, c, g or t
  unsure (1027): n is a, c, g or t
  unsure (1033): n is a, c, g or t
  unsure (1037): n is a, c, g or t
gtgcaaattaaactgttctgtacctgttggccttcctcctcgctcctcttggttctcgctggttgccgggagctggggtcgagagtacttctgttgttcgcacggcgaggcggcggcggagaccggtcagaaggaatgtcttcgtcccaaatcgcgccggcagatcatgtgtgctatgtgcactgcagcttctgcaacacagttctcgcggtgagtgtcccggggaatagcatgctcaacatcgtgacagttcggtgtggacactgcgcaaatctactgtcagtgaacctgagagcactgacgcactcactcccagaacaagatcatcagctccaggagaacatcaaggtccatggcatcaacggcactttgcatgatgatcatcagtgcggccatttggatcagctcggttcttcttcgtcgtcaaggttccggcggcttccagtgatgtgttcgccacagaacgggcagcacctgctgcaggagaaaacacttaacaacaatgctcgtcctccagagaagaggcagcgggttccgtcggcgtataacagattcatcaaggaagagatacgcaggatcaaagcgaacaaccccgacattaaccacagggaagccttcagcacggcagccaagaattgggcacattatccaaacatccatttcggtttagacgactccgggcgagagggcaagaagaagctcgtggatcatgaggcggcggcgtctgtcgtcgcagtcgcagcagcaccgactgctgctaaaaagatccagggtttctactgatggtagcagatagatgtgtagattgattgatacatcatcgaccgggtggaagaattgataccacaaaaactgctttatatatatgtactgtgagtaaacagttaagattaaacttgtgaagatgtaccgtacatatgaagagctagctagtantgagtcataaaagtgggaaagtgnancatatatagtccgttaaanacaatcacatgaantgctattnngcnccatatanatgcaccttaantaatantggnt

SEQ ID NO: 148 - protein, 215 aa, Zea mays
MSSSQIAPADHVCYVHCSFCNTVLAVSVPGNSMLNIVTVRCGHCANLLSVNLRALTHSLPEQDHQLQENIKVHGINGTLHDDHQCGHLDQLGSSSSSRFRRLPVMCSPQNGQHLLQEKTLNNNARPPEKRQRVPSAYNRFIKEEIRRIKANNPDINHREAFSTAAKNWAHYPNIHFGLDDSGREGKKKLVDHEAAASVVAVAAAPTAAKKIQGFY

SEQ ID NO: 149 - DNA, 563 bp, Oryza sativa
  unsure (96): n is a, c, g or t
  unsure (102): n is a, c, g or t
  unsure (405): n is a, c, g or t
  unsure (408): n is a, c, g or t
  unsure (441): n is a, c, g or t
  unsure (457): n is a, c, g or t
  unsure (545): n is a, c, g or t
  unsure (551): n is a, c, g or t
  unsure (555): n is a, c, g or t
  unsure (559): n is a, c, g or t
atggcgagcgcggcaagctgcaggaacaacaactccccggcggcggcggcggctccgccgccgccaacgtcgcaggggaaagcggcggcgaaaganccgtcnccccggacgaacaccgccgtcatcaacagacctccggagaagaggcagcgtgtgccatcggcgtacaaccgcttcatcaaggacgaaatccaacgcatcaaggctggcaatcccgacatctcgcacagggaggccttcagcgcggctgccaagaactgggcacactttccgcacatccactttggactgatgccggatcaccaagggctcaagaagaccaacctgcttcctcaggatcatcagagaaaggatgggctactaaaggaagggctttatgcaacgggcagctgctgctgcggcggnggncaaaatgggtgtttgcaccgtactaaagcccanctaagaataattagtngagaaattaagttactaatccaacaaagtccaagctaactcaacaatttactagtggtgttcctcctaacaaagctatctaaggcttnctgatnaacncccntggg

SEQ ID NO: 150 - protein, 133 aa, Oryza sativa
  UNSURE (32): Xaa can be any naturally occurring amino acid
MASAASCRNNNSPAAAAAPPPPTSQGKAAAKXPSPRTNTAVINRPPEKRQRVPSAYNRFIKDEIQRIKAGNPDISHREAFSAAAKNWAHFPHIHFGLMPDHQGLKKTNLLPQDHQRKDGLLKEGLYATGSCCC

SEQ ID NO: 151 - DNA, 1308 bp, Oryza sativa
gcaccaggatagctcaatttctccttccttcctctctccatctaatctacacatgcacaaatgttgcagctgatatatggcttagctagcatatgcaaagcaagccttcctgcagtctagtcacctctcaagctacatactcccagtactgcttcatctagctctctctagtagctagctctatcatcatcgatcatcctcctctcaccggccggccaacccaagaagagattattcctcttcatcttcttcttcctctctgttcatcactggcttcggcggcggcggccgcggcggcgatcgatcagctgtgagaagaagaagaagaagaagaagaagaaatgtctgcccagatcgctccggcagagcaagtgtgctatgtgcactgcaacttctgcaacacgattctcgcggtgagtgtcccaggaaacagcatgctgaacatcgtgaccgtccggtgtgggcactgcacgaatctgctgtcagtgaacttgagaggactgatgcactcagccccagcactacaagatcatcatcatcatcatctccaggagagtggtctgagcggatgcttccgtgatcaaagtggctatccggagtttggtttttctgcagcttcgtcgtcttccaagctcaggctgcctcctgctgctgctgccatggtttcctactcgcagcaaaaccagcagctcgagcaagctctccatgctcgccctccagagaagaggcaaagggtaccttcagcctataacagatttattaaggaagagatacgaaggatcaaagcaaacaaccccgacattagccacagggaagccttcagcacagcagccaagaattgggcacattatccaaacatccattttggcctaagccctggccatgagggtggcaagaagctcgtcgacgtcgaccccatcccaactgctccatcttccaagaagatccaaggtttctactcatagattgaggggatcaatctgccgataccgataccgcaaataggaggaagagcatcaagagcacaaaacatatatatactgtgagtaaagaagcaaaggaaaaaagaaaagaaatgctgccaccttacctttgttcatgaccaaaaaacttgtgaagacgtatgtcataagtacatagaagaaatcaactcatatagagtgaaaaaaaacatacaaaaaatcaagctactatagctcatcgatcgactgaaaggctgaataaaccattcgaccataatgttgttacatgtataagtatgtttgaagctagctagctggctagttctttaaaaaaaaaaaaaaaaaa

SEQ ID NO: 152 - protein, 207 aa, Oryza sativa
MSAQIAPAEQVCYVHCNFCNTILAVSVPGNSMLNIVTVRCGHCTNLLSVNLRGLMHSAPALQDHHHHHLQESGLSGCFRDQSGYPEFGFSAASSSSKLRLPPAAAAMVSYSQQNQQLEQALHARPPEKRQRVPSAYNRFIKEEIRRIKANNPDISHREAFSTAAKNWAHYPNIHFGLSPGHEGGKKLVDVDPIPTAPSSKKIQGFYS

SEQ ID NO: 153 - DNA, 927 bp, Glycine max
gcacgagcttaaccctactcctctctctttcacccttctcctcctagctaatccttgttccttcgaaatatgaaccacgaagacaaactcaccatggacctggttccaccatctgaacacctctgctacgttcgttgcaacttctgcaacactgtcctcgcggttggtatcccatgcaagaggctgttagacactgtgacagtgaagtgtggtcactgcagcaacctctcctttctgagcaccagacccccaagttctcaaaaccaaagcattgatcataccaccctaagtctgcaggggttttacagtaatgccaaaaaggggcaagcatcatcttcatcttcctcaccaacaacatccaacgagtcggtgtccccaaaagcagcatcatttgttgtgaaaccacctgagaaaaagcaccgtctcccttctgcttacaaccgtttcatgaaagaggagatacagcgcatcaaagctgcgaaccctgagatcccacatcgagaagctttcagtgctgcagcgaaaaattgggctaggttcattccaaattcaccaaccagttcagtttctgcaactaaagttaacgctgattgatagagttgtggcatgatggtttggagagaattggatcaagttgactaattaatataaactaggtgtcatgcacttagttatattaaactatgtgttgtttaatttctctatctatatcttttaatttccttcagtatcgagatgaactttatgcatgcctatatgtagatccgaaacctgtttaattaatgaaggcaggacctatatgtatttagtaccaaatagtagtatttgttaatctaaaagataaatagctagagtttaatagtaatgttatgaagtaaaaaaaaaaatagtaatgttacatttttaaccaaaaaaaaaaaaaaaaaa

SEQ ID NO: 154 - protein, 174 aa, Glycine max
MNHEDKLTMDLVPPSEHLCYVRCNFCNTVLAVGIPCKRLLDTVTVKCGHCSNLSFLSTRPPSSQNQSIDHTTLSLQGFYSNAKKGQASSSSSSPTTSNESVSPKAASFVVKPPEKKHRLPSAYNRFMKEEIQRIKAANPEIPHREAFSAAAKNWARFIPNSPTSSVSATKVNAD

SEQ ID NO: 155 - DNA, 877 bp, Glycine max
  unsure (353): n is a, c, g or t
atataagagaacgaaaaaagggggctacccaaaatgtcatcctcttccaccacattatcactggaccacctccctccttccgaacagctatgttatgttcactgcaacatttgtgacaccgtcctcgctgtaagtgttccttgcacaagcttgttcaagaccgtcacagtccgatgcggccattgcactaacctcctcccagtgaacatgcgagggttgcttatgccatctcccactcaatttcatttgggtcactctttcttctccccatctcataaccttctggaggagataccaaatccctctccaaattttctgatgaaccaaacaaatttaagtgcatcaaatgagtnctctatgcctgctaggattgcagctgatgagcttccacgaccgatcatgaatagacctcctgagaagagacagagagtcccctcagcgtacaatcgctttatcaaggacgagatccaacgcatcaagtctgtcaatcccgatataactcacagggaagccttcagtgcagctgcaaagaattgggctcacttcccacacatccactttggtctcatgcctgatcagactgtgaagaagacaaatgtgtgccagcaggaaggagaggaggttctcatgaaagatgggttttatgcttcggctaatgttggtgtctcaccctactaattcaccaagtctattttctctttcaagaaattatgcaaagaggaaaaattttccaagttcaccaacctttgaagctcagcaacgatctgattccttaattaacttatatatgcatctatttatggctcaagggcggttatgttgatataactaaggactactactactactacactatgatgattaactcttgggggtg

SEQ ID NO: 156 - protein, 214 aa, Glycine max
  UNSURE (107): Xaa can be any naturally occurring amino acid
MSSSSTTLSLDHLPPSEQLCYVHCNICDTVLAVSVPCTSLFKTVTVRCGHCTNLLPVNMRGLLMPSPTQFHLGHSFFSPSHNLLEEIPNPSPNFLMNQTNLSASNEXSMPARIAADELPRPIMNRPPEKRQRVPSAYNRFIKDEIQRIKSVNPDITHREAFSAAAKNWAHFPHIHFGLMPDQTVKKTNVCQQEGEEVLMKDGFYASANVGVSPY

SEQ ID NO: 157 - DNA, 975 bp, Glycine max
gcacgagatataagagaacgaaaaaagggggctacccaaaatgtcatcctcttccaccacattatcactggaccacctccctccttccgaacagctatgttatgttcactgcaacatttgtgacaccgtcctcgctgtaagtgttccttgcacaagcttgttcaagaccgtcacagtccgatgcggccattgcactaacctcctcccagtgaacatgcgagggttgcttatgccatctcccactcaatttcatttgggtcactctttcttctccccatctcataaccttctggaggagataccaaatccctctccaaattttctgatgaaccaaacaaatttaagtgcatcaaatgagttctctatgcctgctaggattgcagctgatgagcttccacgaccgatcatgaatagacctcctgagaagagacagagagtcccctcagcgtacaatcgctttatcaaggacgagatccaacgcatcaagtctgtcaatcccgatataactcacagggaagccttcagtgcagctgcaaagaattgggctcacttcccacacatccactttggtctcatgcctgatcagactgtgaagaagacaaatgtgtgccagcaggaaggagaggaggttctcatgaaagatgggttttatgcttcggctaatgttggtgtctcaccctactaattcaccagtctattttctctttcaagaaattatgcaaagaggaaaaattttccaagttcaccaacctttgaagctcagcaacgatctgattccttaattaacttatatatgcatctatttatggctcaagggcggttatgttgatataactaaggactactactactactacactatgatgattagctcttggggttgtgcatgcatgcatgtagttctcttcttatgattagactttaattattaactttcatgttcttcaaaaaaaaaaaaaaaaaaaaaaaaaaaaa

SEQ ID NO: 158 - protein, 214 aa, Glycine max
MSSSSTTLSLDHLPPSEQLCYVHCNICDTVLAVSVPCTSLFKTVTVRCGHCTNLLPVNMRGLLMPSPTQFHLGHSFFSPSHNLLEEIPNPSPNFLMNQTNLSASNEFSMPARIAADELPRPIMNRPPEKRQRVPSAYNRFIKDEIQRIKSVNPDITHREAFSAAAKNWAHFPHIHFGLMPDQTVKKTNVCQQEGEEVLMKDGFYASANVGVSPY

SEQ ID NO: 159 - DNA, 749 bp, Glycine max
  unsure (238): n is a, c, g or t
  unsure (621): n is a, c, g or t
  unsure (641): n is a, c, g or t
  unsure (710): n is a, c, g or t
  unsure (713): n is a, c, g or t
  unsure (722): n is a, c, g or t
  unsure (726): n is a, c, g or t
ctttctaggtgtattcgatcctctaatacttaagtggcatatctcttcaccctgtctctcttttccctttctttctatgttttgtttgctctctcctctcccttaacagtaactcaacaatcaagaggatcagatccataggaagttttatctgtccatcaccaaaaccgcgactgatcagtcaatcccatcaatcaaatcaaatcaaatcatcagaaagaaaagaaaagaaaagaanagaaaaaaggaaatcaacaaaaagaggaacaacatgtcctcctcatccacttccttttcaccggaccaacaacacctctctccctccgaccagctctgctatgtccattgcaacttctgtgacactgtcctcgcggtgagtgttccttgcaccagcttgttcaagaatgtcactgtgagatgtggtcattgcaccaaccttctctcagtcaacatgcgtggactgcttctccaagtgccaatcaagcttcaccttgggcacactttcttcactcctcaaaatcttatggaggagattcgtaatgcaccttcaacaaacataatgatgaatcaagctgccggaaccctaatgatttgggtcatgagcaccatgagaggaggggnctgaaagaaaacccctaagnctccatcaagctaataagaacctccagagaagaagacaagggaggttccgtctggcttacaaaccggcntcnatcaagggntggnggattcaaacggtatcaaagggg

SEQ ID NO: 160 - protein, 114 aa, Glycine max
MSSSSTSFSPDQQHLSPSDQLCYVHCNFCDTVLAVSVPCTSLFKNVTVRCGHCTNLLSVNMRGLLLQVPIKLHLGHTFFTPQNLMEEIRNAPSTNIMMNQAAGTLMIWVMSTMR

SEQ ID NO: 161 - DNA, 1045 bp, Glycine max
ttcggcacgaggtcttctgtaaaatcctcgatctagcttgtttcactttgtttcagtcaaggaattctcctctctgatctgccctataaatctactaagcaaacacaaaggacagtcacaatttttttttttgtttaaaaaaatgtcaatggacatgatggcaaccgaacgtgtttgttatgttcactgcaacttctgcaacaccactctagcggttagtgttccatgcagcagtttgctcaccatagttacggttagatgtggacattgtgccaatttgctgacagttaacatgggagcatcacttcaaacttttccttctcaagacactactcagcgattttctaccgttggtaagttacagagacagcatctcagtgttcaagaagcatgcagcaaggaactaggatcatcatcaaagtgcaaaacatttgagaccgtagaccatgatcagcaacctaggattcctcctattcgtcctcctgagaagagacaacgtgttccttctgcttataaccggttcattaaggaggaaatacaaagaattaaggctagtaatccagatatcagccacagggaagcatttagcacagcagccaaaaactgggcacatttccctcacattcactttgggttaaagctggatggcaataagcaagcaaagttggaccagggggatggtactcaaaagtctaacggattttactgattacatatatataaacggaagtttatcattatcaactggttttttctgtgcttgacctaaatcagtgaaaaatgaggttgatcaaatttcccaatcatacaactggatgggaagactcctgaaaattgacctcagcatctcacccatctttaatatatattattattatatgtatgtgttgcctttttctagttgttatgaaatgattgctattcttgtgattgcattaaattactatgttgaacttagtcacttaagtaagtaaacattattgtaagtttccttctctttataatgtgtcttgctatttagtatttaaaaaaaaaaaaaaaaaaa

SEQ ID NO: 162 - protein, 188 aa, Glycine max
MSMDMMATERVCYVHCNFCNTTLAVSVPCSSLLTIVTVRCGHCANLLTVNMGASLQTFPSQDTTQRFSTVGKLQRQHLSVQEACSKELGSSSKCKTFETVDHDQQPRIPPIRPPEKRQRVPSAYNRFIKEEIQRIKASNPDISHREAFSTAAKNWAHFPHIHFGLKLDGNKQAKLDQGDGTQKSNGFY

SEQ ID NO: 163 - DNA, 825 bp, Glycine max
  unsure (566): n is a, c, g or t
  unsure (636): n is a, c, g or t
  unsure (741): n is a, c, g or t
  unsure (753): n is a, c, g or t
  unsure (807): n is a, c, g or t
agaagaaaagaaagaaaataatgtcaatggaaatgatggcaaccgaacgtgtttgttatgttcactgcaacttctgcaacaccattttggcggttagtgttccatacagcagtttgctaaccatagtgacggttagatgtggacattgtgccaatttgctatcagttaacatgggagcgtcacttcaagcatttccccctcaagaccctcagaaacagcttctaagctttgaagaaccaagcagctgcaaggaactgggatcatcatcttcaaaatgtaacaaaatagcgccatttcacgaggcagtagagcatgaacaacctaggattcctcccattcgtcctacagagaagagacatcgtgttccttctgcttataatcgcttcattaaggaggaaattcaaaggattaaggctagtaatccagatatcagccacagggaggctttcagctcagcagccaaaaactgggcacatttccctcacattcactttgggttaaagaacttaaagctggatggcaacaagcaagaaaagttggaccagggggaaggagctgaaaagtcnaatggattctactgatgatataaatggaagcctgtgagtatgagcttgtttttgttatgcttgacctaantcaagtgaaaaatatgaggttgatcaaatttcttcccaactatatccgtacaactggatgggagactcctgcaagttaaactcagcctctcacaccaatgtttantaggacctacanaatataatgtattgccccttttctatatatccgttgttattgaaaatggaatgncattccctggttgcttgg

SEQ ID NO: 164 - protein, 186 aa, Glycine max
MSMEMMATERVCYVHCNFCNTILAVSVPYSSLLTIVTVRCGHCANLLSVNMGASLQAFPPQDPQKQLLSFEEPSSCKELGSSSSKCNKIAPFHEAVEHEQPRIPPIRPTEKRHRVPSAYNRFIKEEIQRIKASNPDISHREAFSSAAKNWAHFPHIHFGLKNLKLDGNKQEKLDQGEGAEKSNGFY

SEQ ID NO: 165 - DNA, 937 bp, Glycine max
agaagaaaagaaagaaaataatgtcaatggaaatgatggcaaccgaacgtgtttgttatgttcactgcaacttctgcaacaccattttggcggttagtgttccatacagcagtttgctaaccatagtgacggttagatgtggacattgtgccaatttgctatcagttaacatgggagcgtcacttcaagcatttccccctcaagaccctcagaaacagcttctaagctttgaagaaccaagcagctgcaaggaactgggatcatcatcttcaaaatgtaacaaaatagcgccatttcacgaggcagtagagcatgaacaacctaggattcctcccattcgtcctacagagaagagacatcgtgttccttctgcttataatcgcttcattaaggaggaaattcaaaggattaaggctagtaatccagatatcagccacagggaggctttcagctcagcagccaaaaactgggcacatttccctcacattcactttgggttaaagaacttaaagctggatggcaacaagcaagaaaagttggaccagggggaaggagctgaaaagtctaatggattctactgatgatataaatggaagcctgtgagtatgagcttgtttttgttatgcttgacctaaatcagtgaaaaatatgaggttgatcaaatttcttcccaatatatcgtacaactggatgggagactcctgcaagttaacctcagcctctcacaccaatgtttaatagtactacatatatatgtattgcccttttctatatatcgttgttatgaaatgattgctattcttgtgattgcatttattgtgttgaatttgagcacttaagtaaacaacacgttcctctatatatcataataatgtccctttataatatgatcataatctataatattattggagtatgcaaaaaaaaaaaaaaaaaa

SEQ ID NO: 166 - protein, 186 aa, Glycine max; identical to SEQ ID NO: 164

SEQ ID NO: 167 - DNA, 859 bp, Triticum aestivum
  unsure (855): n is a, c, g or t
ctacacacacactcgtccccctcctccaccttcttcttcttcttcttcttcttcttcttctacctcccaccctcctaccctccacatcctcgtcttctgttggctcttcgcgcgcgcccaagctcactcttgacctctccgtcccaccgacgccggccacccaccgccggaacgacccgtcgtccgttggctagcgagcatgcagagcatggatttggtgtcgccgtccgagcacctctgctacgtgcgctgcacgtactgcaacaccgtgctcgcggttggggttccatgcaagaggctgatggacacggtgactgtgaaatgcggccactgcaacaacctctcctttctcaagccacgggcgccgcccatggtgcaagccctctccccaaatgaccaacaccaccccatggggccgttccagggatgcactgactgcaggaggaaccagccactgccaccgctggcctcgccgacatcaagtgatgccagccccagagctccctttgttgtcaagcccccagagaagaaacaccgcctaccatcagcctacaatcgcttcatgagggaggaaatacagcgtatcaaagctgcaaagccagacatccctcacagagaagccttcagcatggctgctaagaactgggcgaagtgcgaccctcgctgctcatcgactgtctctgcttccaacagcgccccggagcccagaatagtagtgcccggtcctcagctgcaggagagggccacccgagcaagtcgttgagagcttcgacatcttcaagcagatggagcgcagcacctagggcatcataagcatgctgggattaattagtactgctaccacatgcgtcgatnactt

SEQ ID NO: 168 - protein, 187 aa, Triticum aestivum
MQSMDLVSPSEHLCYVRCTYCNTVLAVGVPCKRLMDTVTVKCGHCNNLSFLKPRAPPMVQALSPNDQHHPMGPFQGCTDCRRNQPLPPLASPTSSDASPRAPFVVKPPEKKHRLPSAYNRFMREEIQRIKAAKPDIPHREAFSMAAKNWAKCDPRCSSTVSASNSAPEPRIVVPGPQLQERATRASR

SEQ ID NO: 169 - DNA, 1115 bp, Triticum aestivum
gcacgagctacacacacactcgtccccctcctccaccttcttcttcttcttcttcttcttcttcttctacctcccaccctcctaccctccacatcctcgtcttctgttggctcttcgcgcgcgcccaagctcactcttgacctctccgtcccaccgacgccggccacccaccgccggaacgacccgtcgtccgttggctagcgagcatgcagagcatggatttggtgtcgccgtccgagcacctctgctacgtgcgctgcacgtactgcaacaccgtgctcgcggttggggttccatgcaagaggctgatggacacggtgactgtgaaatgcggccactgcaacaacctctcctttctcagcccacggccgccgcccatggtgcagcccctctccccaaatgaccaccaccaccccatggggccgttccagggatggactgactgcaggaggaaccagccgctgccaccgctggcctcgccgacatcaagtgatgccagccccagagctccctttgttgtgaagcccccagagaagaaacatcgcctaccatctgcctacaatcgcttcatgagggaggaaatacaacgtatcaaagctgcaaagccagacatccctcacagagaagccttcagcatggctgctaagaactgggcgaagtgcgaccctcgctgctcaacgactgtctctgcttccaacagcgccccagagcccagaatagtagtgcccggtcctcagctgcaggagagggccaccgagcaagtcgttgagagcttcgacatcttcaagcagatggagcgcagcgcctaaggcatcacaagcatgctgggattaattagtactgctaccgcatgcatcggttacttatcagctagctcatcatcatcatccgtcgctatgcatatatataatgcataagcgcacgcgtttaatttatgtttggttacttcgttgctgctgttgctgtgtcgttaagttgatggtgttgtctgttatatttgttgttggagcgtacgtacgcaccctttaattatgaacagctgctaccttataatattttttcatcgcgaaaaaaaaaaaaaaaaaaaaaaaaaaaaaaaaaaaaaaaaaaataaa

SEQ ID NO: 170 - protein, 200 aa, Triticum aestivum
MQSMDLVSPSEHLCYVRCTYCNTVLAVGVPCKRLMDTVTVKCGHCNNLSFLSPRPPPMVQPLSPNDHHHPMGPFQGWTDCRRNQPLPPLASPTSSDASPRAPFVVKPPEKKHRLPSAYNRFMREEIQRIKAAKPDIPHREAFSMAAKNWAKCDPRCSTTVSASNSAPEPRIVVPGPQLQERATEQVVESFDIFKQMERSA

SEQ ID NO: 171 - DNA, 549 bp, Triticum aestivum
  unsure (90): n is a, c, g or t
  unsure (404): n is a, c, g or t
  unsure (416): n is a, c, g or t
  unsure (421): n is a, c, g or t
  unsure (441): n is a, c, g or t
  unsure (448): n is a, c, g or t
  unsure (456): n is a, c, g or t
  unsure (462): n is a, c, g or t
  unsure (476): n is a, c, g or t
  unsure (494): n is a, c, g or t
  unsure (503): n is a, c, g or t
  unsure (506): n is a, c, g or t
  unsure (536): n is a, c, g or t
  unsure (538): n is a, c, g or t
  unsure (541): n is a, c, g or t
ggaaagctagacagctcaatttctccttcctctctgcccatacatatctctctctctctccatcgatctaacctacacacccagagaaanagagagaagcagcagtagcacatgtaacctagctagcctgcagttctccgcgccaacgcttcttcttcttggctgccgcctggtgaacctcgccgtagtctgaacggctaggggggcagcgaggcggcggctccaggggataatcaggaggaatgtcgtcgtcgggccagatcacgccggcagaagaagtctgctacgtccactgcaacttctgcaacaccgtactcgcggtgagtgtccctgggaacagcatgctcaacattgtgacagtccggtgtgggcactgcacaaacctactttcccgtgagcctganagggcagatgcnctcancaatccctcccgcaacaaanggtccanggaaaatnacctgngcaagcccaatggnaatgaacaacttcattcncgattaaancancgtctacaataaccccggagtttgggtcgncntcntcctcatg

SEQ ID NO: 172 - protein, 50 aa, Triticum aestivum
MSSSGQITPAEEVCYVHCNFCNTVLAVSVPGNSMLNIVTVRCGHCTNLLS

SEQ ID NO: 173 - DNA, 1078 bp, Triticum aestivum
gcacgagggaaagctagacagctcaatttctccttcctctctgcccatacatatctctctctctctccatcgatctaacctacacacccagagaaagagagagaagcagcagtagctcatgtaacctagctagcctgcagttctccacggcaacgcttcttcttcttggctgccgcctgttgaacctcgccgtggtctgaacggctaggggggcagtgaggcggcggcgccaggggataatcagaaggaagaatgtcgtcgtcgggccagatcacaccggcagaagaagtctgctacgtgcactgcaacttctgcaacaccgtactcgcggtgagtgtccctgggaacagcatgctcaacatcgtgacagtccggtgcgggcactgcacaaacctactttcggtgagcctgagagggcagatgcactcaccggtccctcctgcggcacaggtccaggagagcagcctgagcaagcccaatggcagcaacggcttcattcgtgaccacggcagcgcctacaatagcccggagtttgcttcgtcttcttcttcatcgtcgtccaaattccggatgccgacgatgatgttctcatcgcaaaacgatctgctgcaggagcaaacgctgcacgcacgtcctcctgagaagaggcagcgtgttccttcggcgtacaacagattcatcaaggaagagatacgaaggatcaaagcaaacaaccccgacattagccacagggaagctttcagcactgccgcaaagaactgggcacattatccaaacatccatttcggtctaaaccccgagcgcgacggtggcaagaggctcgccgtcgacgatgccgcgccggctgccaagaagatccaaggtttctgttcatagacacgacggctgggagtccaaacaagaacaactgtatctatatatagtattagtaatatcgcatatgtgtatacgtaccgcatgtgagtaagtaaagatgcaaaggaaaagagaagtcgctacgtaccttaccttatacaattgtacgtacatatatatatatatatatggcgatcgagtgaataaaaaaaaaaaaaaaaaa

SEQ ID NO: 174 - protein, 207 aa, Triticum aestivum
MSSSGQITPAEEVCYVHCNFCNTVLAVSVPGNSMLNIVTVRCGHCTNLLSVSLRGQMHSPVPPAAQVQESSLSKPNGSNGFIRDHGSAYNSPEFASSSSSSSSKFRMPTMMFSSQNDLLQEQTLHARPPEKRQRVPSAYNRFIKEEIRRIKANNPDISHREAFSTAAKNWAHYPNIHFGLNPERDGGKRLAVDDAAPAAKKIQGFCS

SEQ ID NO: 175 - DNA, 866 bp, Triticum aestivum
ttcaccttcttcttctctccatcttccttctttcgtcttcctcatcctctcccccctccccttcttttattcgcggaggtatcttgctacgtcggcaagggaaataatgtcggcacagatcgcgccgccggagcatgtctgctacgtgcactgcaacttctgcaacacaattctcgcggtcagtgttccaagtaatagcatgctgaacatcgtcaccgtccgttgcgggcactgcactagcctgctgtcggtaaacttgaggggattaatccagtcgccacctgtgcaagatcattcccaggagaatttcaaggcccacaatatcagctttcgtggaaattacccggactatggcacatcttctaaataccggatgccaatgatgttctcaacaaaaagtgaccaagagcatatgctccacatgagaccagctccagagaagaggcagcgggttccttcagcgtataaccgatttattaaggaggagatacgaaggataaaaacaaacaatcctgacataagccacagagaagccttcagcaccgcagcaaagaattgggcgcatttcccaaacattcatttcgggctaggctccaatgagagcagcaagaagctggacgaggccatcgcggcacctaccccccagaaagttcaaggtctctactgagacatatattcctatatgcatgatactttcatattgtaagtaacttagggaaaacctaagttaatttctgaatcagtttgtgagtgagtacatagatcatgagcgagtgatatgcatgaagtgagaaagaggcatatgggagtgtatgcagtagtagctatcgtacatgcatatagaagacgtctgaataaatccctgg

SEQ ID NO: 176 - protein, 186 aa, Triticum aestivum
MSAQIAPPEHVCYVHCNFCNTILAVSVPSNSMLNIVTVRCGHCTSLLSVNLRGLIQSPPVQDHSQENFKAHNISFRGNYPDYGTSSKYRMPMMFSTKSDQEHMLHMRPAPEKRQRVPSAYNRFIKEEIRRIKTNNPDISHREAFSTAAKNWAHFPNIHFGLGSNESSKKLDEAIAAPTPQKVQGLY

SEQ ID NO: 177 - DNA, 805 bp, Zea mays
gcacgagggtagccggtaggcgagagagtcaggattcaggacgcggcgaggccaccatgagcactctcaagttctgccgggaatggtaaaagcgacgaaattcaacaacatgctgtacccgcgggaggacaaggagacgcgcaccctcctgtacgcgtgccaaacgtgcgagcatgaggagattgccactgatacttgtgtgtacaaaagggttatccgcaagcctggtggtgagcccaaggatgtcctgaaggatgcagcaactgatcctagcctgcctcgcaccagaagcgtcagatgttacaactgcaaccatccagaagctgccttttttcaggccccgactaagggagaacaagccatgacgctgtacttcatctgctgcaacccaagctgcgggcacaggtggagggactgagaaggatctggcttggtcttcgctgcaaacctgccgtattgttagcctatcacataaatattgtaggtacaagttgtgccgtcaactgacgtttgatgcaagcttataagctactataacctcgtaacaaaacgatggtttggctggagacgaaatctgttgttcctgatgataagccaaaaactttacggccgagctcaggtaagaaacagaagcggctatgaactactgtggtgtttggtttgaggaatgagctagtctatcatcttctcactcctcactatttttgtttggtttgtggaatagaatgagttgatccctcccccaaaaaaaaaaaaaaaaaaaaaaaaaaaaaaaaaaaaaaaaaaaaaaaaaaaaaaaaaaaaa

SEQ ID NO: 178 - protein, 111 aa, Zea mays
MVKATKFNNMLYPREDKETRTLLYACQTCEHEEIATDTCVYKRVIRKPGGEPKDVLKDAATDPSLPRTRSVRCYNCNHPEAAFFQAPTKGEQAMTLYFICCNPSCGHRWRD

SEQ ID NO: 179 - DNA, 619 bp, Zea mays
caaatctccactcccaatcaaccacttgctgcaaagaggaatacgattcagcttagctcagctccaccaccaccaagaacaagatctcgacgaagcagccagacgacaggcaggtagcaccggggtcaacgcggcagacaaacaggctctcccgctcgtcagctagcagccatgagtaccatgaagttttgccgtgaatgcaacaacatcctgtaccccaaggaggaccgggagcagaaggtgctcctctacgcctgccggaactgcgaccaccaggaggtcgcggacaacaactgcgtgtaccggaacgtggtgcaccacagcgccggggagttcacccaggtgctccaggacgtggccggcgaccccacgctgccccgcaccaagtccgtgcgttgctcctcctgcggccacggcgaagccgtcttcttccaggccactgcgagaggggaggaagggatgacgctcttcttcgtctgctgcaacccgagctgcggcaaccgttggagaaaataatggacggttcctctggcgcaacaaccaagacgacatgattttttttgcaagattttcatccgacaagacctgctgctccccccatatgagcatgtcaactgat

SEQ ID NO: 180 - protein, 114 aa, Zea mays
MSTMKFCRECNNILYPKEDREQKVLLYACRNCDHQEVADNNCVYRNVVHHSAGEFTQVLQDVAGDPTLPRTKSVRCSSCGHGEAVFFQATARGEEGMTLFFVCCNPSCGNRWRK

SEQ ID NO: 181 - DNA, 649 bp, Oryza sativa
gcacgaggtgaattggagaggaggaggaagccatcgatggccatgagcgccctcaagttctgcggcgaatgcagcaacatgctctacccgcgggaggacaaggagacgcacaccctgctctacgcctgcaattcctgcgagcaccaggagcctgccactgacacttgtgtgtacaaaagggttctccgtaaacctgctggggaacccaaagatatcctaaaagatgcagcaactgatcccaccctgcctcgcaccagaagtattaaatgttacaactgtggccatccagaggctgctttttttcaggctccaactaagggggagaaaggcctgacactgtacttcatctgctgcaacccaagctgtggtcacaggtggagggattgacggcaaggttcatggtgctgaatcttgcccgttcttgtgttcatgctcatacccggtgttatctgaaggactggaacttctacaagtaatgtagtttgtgaattgtgtgactgatgtagctccgaggtcatttaactgctgtgattgtcttgtcaacttaatgtgtccggggttgttgggtgccctggaccctgttgtcactttggtccaattctgaaagggaaaagtacaccgaaggtccctcaaaaaaaaaaaaaaaaaa

SEQ ID NO: 182 - protein, 116 aa, Oryza sativa
MAMSALKFCGECSNMLYPREDKETHTLLYACNSCEHQEPATDTCVYKRVLRKPAGEPKDILKDAATDPTLPRTRSIKCYNCGHPEAAFFQAPTKGEKGLTLYFICCNPSCGHRWRD

SEQ ID NO: 183 - DNA, 482 bp, Oryza sativa
  unsure (95): n is a, c, g or t
  unsure (162): n is a, c, g or t
atcactgtaaaacatcccttcttcttcttcttcactagcttctcactcactcacctcctccatattcccctttcttgcaaaggagaaaggaacangaataggattcagctcaggtcagctccatcactgcagagaatataaagatctgaaagaggcaagcanacaaggtcaggtcaggtcaggtcagaggagaagctagcagccatgagtaccatgaaattttgccgcgaatgcaacaacatactgtatcccaaggaggatagggaccagaagattctgctctatgcctgcaggaactgtgaccaccaggaggttgcagacaacaactgcgtctaccggaatgtggtgcaccacagcgccggagagttcacccaagtgctccaggatgtcgccggcgatccgactctccctcgcaccaaggcggtccggtgcgcggtctgtggccacggcgaggccgtgttcttccaggccactgccaagag

SEQ ID NO: 184 - protein, 92 aa, Oryza sativa
MSTMKFCRECNNILYPKEDRDQKILLYACRNCDHQEVADNNCVYRNVVHHSAGEFTQVLQDVAGDPTLPRTKAVRCAVCGHGEAVFFQATAK

SEQ ID NO: 185 - DNA, 876 bp, Oryza sativa
gcacgagatcactgtaaaacatcccttcttcttcttcttcactagcttctcactcactcacctcctccatattcccctttcttgcaaaggagaaaggaacaagaataggattcagctcaggtcagctccatcactgcagagaatataaagatctgaaagaggcaagcagacaaggtcaggtcaggtcaggtcagaggagaagctagcagccatgagtaccatgaaattttgccgcgaatgcaacaacatactgtatcccaaggaggatagggaccagaagattctgctctatgcctgcaggaactgtgaccaccaggaggttgcagacaacaactgcgtctaccggaatgtggtgcaccacagcgccggagagttcacccaagtgctccaggatgtcgccggcgatccgactctccctcgcaccaaggcggtccggtgcgcggtctgtggccacggcgaggccgtgttcttccaggccactgccagaggggaggaagggatgaccctgttcttcgtctgctgcaacccgagctgcggtcacagatggagagaatgagatcaatttgtagtcaaccaagtgaagaaagtcattgatgcaaatgatcagagagacatatgattttgatttcatccaagagacattccatagaagcatagactgattgtatgtttaaatttttaaaaacacattcaggcatcggtattttgtgtaacttctgaaggaaaaggatcaagactactaggataaaacattctgtggtctattccttccttataaacaaaggatgggatgaggacagttttcttggtgattcaaaaaaaaaaaaaaaaaaaaaaaaaaaaaaaaaaaaaaaaaaaaaaaaaaaaaaaaaaaaa

SEQ ID NO: 186 - protein, 114 aa, Oryza sativa
MSTMKFCRECNNILYPKEDRDQKILLYACRNCDHQEVADNNCVYRNVVHHSAGEFTQVLQDVAGDPTLPRTKAVRCAVCGHGEAVFFQATARGEEGMTLFFVCCNPSCGHRWRE

SEQ ID NO: 187 - DNA, 494 bp, Glycine max
  unsure (392): n is a, c, g or t
  unsure (409): n is a, c, g or t
  unsure (449): n is a, c, g or t
  unsure (464): n is a, c, g or t
gagcatccagtaagtttcctactcccttctcatcgttggcaagatgagtgccatgaaattttgccgtgaatgcaataacattctgtaccctaaggaagacagagaccagaaagttcttctcttcgcttgccgcaactgcgaccatcaggaggttgctgataacttctgtgtgtataggaatgagatacatcactctgttggagagcgcactcaggtgttgcaagatgtcgctgcagatccaacgcttcctcgaaccaagtctgttcgctgcagtcaatgcaatcatggtgaagctgtctttttccaagcaactgccagaggggaagaaggaatgacactttttttcgtttgctgcaacccaaactgtggacacagatgggagagactgaaanttgtgcctcctcagatnaaaaggtcaataatgggggagatctaactaatttgtgggntatctgaaaaaaacntggctggatgccggggaaaagtaataactg

SEQ ID NO: 188 - protein, 114 aa, Glycine max
MSAMKFCRECNNILYPKEDRDQKVLLFACRNCDHQEVADNFCVYRNEIHHSVGERTQVLQDVAADPTLPRTKSVRCSQCNHGEAVFFQATARGEEGMTLFFVCCNPNCGHRWER

SEQ ID NO: 189 - DNA, 762 bp, Glycine max
gcacggagcatcgagtaggtttcctactcccttctcatcgttggcaagatgagtgccatgaaattttgccgtgaatgcaataacattctgtaccctaaggaagacagagaccagaaagttcttctcttcgcttgccgcaactgcgaccatcaggaggttgctgataacttctgtgtgtataggaatgagatacatcactctgttggagagcgcactcaggtgttgcaggatgtcgctgcagatccaacgcttcctcgaaccaagtctgttcgctgcagtcaatgcaatcatggtgaagctgtctttttccaggcaactgccagaggggaagaaggaatgacactttttttcgtttgctgcaacccaaactgtggacacagatggagagactgaaatttgtgcttcctcagatcaaaggttcaatattggggagatctaactatttgtggttatctgaaaaaacttggctgatgcggggacagtaatactgaagtatttgtgttacctgtttaactgcagttcctgatcaaataattaatacagttaatggacaaactgttgtttgccaatgctgataaattctgaggatgggcataaatttcatggtttgttaaaaggaaaaaggatgagtgacactgcttttatggatgggcctaactttcttggtggggagttaggaatcaaaatgacttttttttttgttatatgctatattatttgatgaaaaattcttattaaaagttcaaaaaaaaaaaaaaaaaa

SEQ ID NO: 190 - protein, 114 aa, Glycine max
MSAMKFCRECNNILYPKEDRDQKVLLFACRNCDHQEVADNFCVYRNEIHHSVGERTQVLQDVAADPTLPRTKSVRCSQCNHGEAVFFQATARGEEGMTLFFVCCNPNCGHRWRD

SEQ ID NO: 191 - DNA, 587 bp, Triticum aestivum
  unsure (506): n is a, c, g or t
  unsure (518): n is a, c, g or t
  unsure (529): n is a, c, g or t
  unsure (535): n is a, c, g or t
  unsure (545): n is a, c, g or t
  unsure (564): n is a, c, g or t
  unsure (580): n is a, c, g or t
gagaagcgaagccaaggggacagcagcgggcgagagaggcagagagaggcgaggagaggacatcgccgtcgccatgagcgccctcaagttctgcagcaaatgcgacaacatgctgtatccgcaggaggacaaggagatgcacaccctcctctacgcctgctcgaattgccagcaccaggagattgctactgatacttgtgtgtacaaaagggttcttcggaaatctgctgatgaacctaaagacaccctaaaagacgcagctgctgatgcgtctctgccacgcaccagaagtgttaaatgctacaactgtggctatccagaagctgcttatttccaggccccgacgaagggagagttgggcctgacctgtacttcatctgctgcagcctactgtgggcacaagtgggagggactgactgactgactgacaaggggggagcctccccagaacggatgttcgtcttggactgaaacttgactggcctgtgttctcatgactgcgttgnctaacttgttancttgtggaacngtgtcnaagttagggnactcacatgtgacttacgnttcgacttgtccctcnttaaaaa

SEQ ID NO: 192 - protein, 116 aa, Triticum aestivum
MSALKFCSKCDNMLYPQEDKEMHTLLYACSNCQHQEIATDTCVYKRVLRKSADEPKDTLKDAAADASLPRTRSVKCYNCGYPEAAYFQAPTKGELGLTCTSSAAAYCGHKWEGLTD

SEQ ID NO: 193 - DNA, 589 bp, Triticum aestivum
  unsure (533): n is a, c, g or t
  unsure (541)..(542): n is a, c, g or t
gggattctaaggctccgctccacaccaagagtagcgaagatctctgatttgagagagggaagcatcgaatcagccgacaggaggaggtctcagtcaccaacccagcagcagccatgagtgccatgaagttttgccgtgaatgcaacaacatcttgtatcccaaggaggaccgggaccagaaggtgctcctcttcgcctgcaggaactgcgaccaccaggaggttgcagacaacaactgtgtctaccgcaacgtggtgcaccacagcgctggagagttcacccaggtgctccaggacgtcgccggcgacccaacacttccccgcaccaaggaagtccggtgcgccgtctgtggtcacggcgaagctgtcttcttccaggccaccgcgagaggtgaggaggggatgacgctcttcttcgtctgctgcaacccgagctgcggtcatcggtggagaaatgttgtcatcaccaacgatacgattacgatcacatctaagattgttttcttctccagaatattcccagtacataattgntgtagttnnattatgaggggatacattcataccatagaaacacgcttacggtaaat

SEQ ID NO: 194 - protein, 116 aa, Triticum aestivum
MSAMKFCRECNNILYPKEDRDQKVLLFACRNCDHQEVADNNCVYRNVVHHSAGEFTQVLQDVAGDPTLPRTKEVRCAVCGHGEAVFFQATARGEEGMTLFFVCCNPSCGHRWRNVV

SEQ ID NO: 195 - DNA, 761 bp, Triticum aestivum
gcacgaggggattctaaggctccgctccacaccaagagtagcgaagatctctgatttgagagagggaagcatcgaatcagccgacaggaggaggtctcagtcaccaacccagcagcagccatgagtgccatgaagttttgccgtgaatgcaacaacatcttgtatcccaaggaggaccgggaccagaaggtgctcctcttcgcctgcaggaactgcgaccaccaggaggttgcagacaacaactgtgtctaccgcaacgtggtgcaccacagcgctggagagttcacccaggtgctccaggacgtcgccggcgacccaacacttccccgcaccaaggaagtccggtgcgccgtctgtggtcacggcgaagctgtcttcttccaggccaccgcgagaggtgaggaggggatgacgctcttcttcgtctgctgcaacccgagctgcggtcatcggtggagagaatgatgtgtccatcacccaaccgatgacggatttcaccgatgcaacagtctgagagagttgttttttctttcttcccaagagatattttccccagtagcatgaattggctgtatgtttcagatgtattgaggcggcatatcattttcataactccatgaggaaaaaacaaccgcgtctaccggggtaaaaatatccctgtggtccattgcattaatcaaaggatgctacgaggacatttttctcaaaaaaaaaaaaaaaaaaaaaaaaaaaaaaaaaaaaaaaaaaaaaaaaaaaaaaaa

SEQ ID NO: 196 - protein, 114 aa, Triticum aestivum
MSAMKFCRECNNILYPKEDRDQKVLLFACRNCDHQEVADNNCVYRNVVHHSAGEFTQVLQDVAGDPTLPRTKEVRCAVCGHGEAVFFQATARGEEGMTLFFVCCNPSCGHRWRE

SEQ ID NO: 197 - DNA, 483 bp, Zea mays
  unsure (447): n is a, c, g or t
  unsure (465): n is a, c, g or t
gcggctccgccctcctctgtgtcttgcttccacctgaaaacccacacgctcgcgtcgcgcctcccagctcttccgcgaagaaacaccgaggcccatggcgccgagaacgtcagagagagcgatgacatcggcggccgcggggctcgcgcgtggcgccggcccgcactacagaggcgtcaggaagcggccgtggggccggtacgccgcggagatccgcgacccggccaagaagagccgcgtgtggctcggcacgttcgacacgcccgaggacgccgcgcgggcctacgacgccgccgcgcgcgagtaccgcggcgccaaggccaagaccaacttctccttcccttcgtgcctgccgctcgccgccgcggacgtcggcggcgcctgccggagcggcaacagcagcagcatcaccaccaccgtcggactccttcgggggcgacgtggcangcgactctgatctttagngtgaaactacgaacatgt

SEQ ID NO: 198 - protein, 83 aa, Zea mays
MAPRTSERAMTSAAAGLARGAGPHYRGVRKRPWGRYAAEIRDPAKKSRVWLGTFDTPEDAARAYDAAAREYRGAKAKTNFSFP

SEQ ID NO: 199 - DNA, 984 bp, Zea mays
gcacgagaaccgcctcgctgaaccggaagacccgcacacacacgccacttgtagaccatggcgccccgggtggcggacaagtcgcctctaccgccggccaccggcctggggctgggcgttggcggaggagtcggaggcgtgggcatgggcccgcactacagaggcgtgaggaagcgtccatggggacgttacgccgccgagatccgcgaccctgccaagaaaagccgcgtgtggctcggcacgtacgacacggccgaggaggccgccaaggcgtacgattccgccgcccgcgagttccgaggcgccaaggccaagacgaacttcccgttcccgtcccagtgctccgtcgcctccggtgctgccggtagcgccagtagcaacagcaccgtggattcgagcggtggcggtagcggctgtggcatccaggcgcctatgcaggccatgccgcttcctccggctctcgacctcgacctcttccatcgggcggccgccgtgaacgcagtctccaccggcatgcggtttccgttcaagggctatcctgtcgcctgcccgacgccacagcagtactttttctacgagcaggcggctgccgcggcatccggataccggatgctcaaggtcgctccaccggccgtgactgtggccgcggttgcgcagagcgactccgactcgtcgtctgtggttgatcactccccttcgcctcccgcggtgacggcaaacaaggtgggcttcgaactggatctgaactggcccccgccggcagagaactaggcaggccggagtttttggctgacgacttagtagcttccttttcccttttgccttcatcaggaatgttacttgtggttgttttggtcctgtatggctgtattcttgttctgtagactaagagatggggagtcttgtaaatattttttttccgtcgagacggaaatgaactgagatctgttcgtctgtctgatcaaaaaaaaaaaaaaaaaaaaa

SEQ ID NO: 200 - protein, 237 aa, Zea mays
MAPRVADKSPLPPATGLGLGVGGGVGGVGMGPHYRGVRKRPWGRYAAEIRDPAKKSRVWLGTYDTAEEAAKAYDSAAREFRGAKAKTNFPFPSQCSVASGAAGSASSNSTVDSSGGGSGCGIQAPMQAMPLPPALDLDLFHRAAAVNAVSTGMRFPFKGYPVACPTPQQYFFYEQAAAAASGYRMLKVAPPAVTVAAVAQSDSDSSSVVDHSPSPPAVTANKVGFELDLNWPPPAEN

SEQ ID NO: 201 - DNA, 1260 bp, Zea mays
gtcaaagcgctcgtccctgactggtgactgcgccgagttttattccttgttgccgctccaccacccgctctcgccattgccaccctttttaacccccccttcctctcctccaccaccgctataagtccctcctccgctctcctctcccacctcaaatcccagacgccacgccacccaacacatacaaacacacgcacgcgcgcgcgcgcgcctcccgctgttccgcaaaacaaaggaaacgaaggagaggaggccatggcgccgagaacgtcagagaaaaccatggcaccggcggcggccgctgccacggggctcgcgctcagcgttggcggcggcggcggggccggcggcccgcactacagaggcgtgaggaagcggccgtggggccggtacgcggcggagatccgcgacccggcgaagaagagccgggtgtggctcggcacctacgacacggccgaggacgccgcgcgggcctacgacgccgccgcgcgcgagtaccgcggcgccaaggccaagaccaacttcccttacccctcgtgcgtgcccctctccgcagccggttgccggagcagcaacagcagcaccgtcgagtccttcagcagcgacgcgcaggcgcccatgcaggccatgccgctcccgccgtcgctcgagctggacctgttccaccgcgcggcggccgcggccacgggcacgggcgctgccgccgtacgcttccctttcggcagcatccccgttacgcacccgtactacttcttcgggcaggccgcagccgcagccgcggaagcagggtgccgtgtgctcaagctggcgccggcggtcaccgtggcgcagagcgactccgactgttcgtcggtagtggatctgtcgccgtcgccaccggccgctgtgtcggcgaggaagcccgccgcgttcgatctcgacctgaactgctcaccgccgacggaggcggaagcctagtcgtcgaagcttttaatgactgtctgtcttcttagttctttcttctcctttttctcgaggaaaattcggtactactaagctgagagacgctctcctccgacagacgacgtcgacgacgggcatttttgtaaatagtttttgcgccgggacctttttagtttatgatgaaagctgtattgtcaccgaagacaggtcctgccggcgttgttatggaccggattactatattatattatgcactactagtattttgatagccatgagaaaaaaaaaaaaaaaaaaaaaaaaaaaaaaaaaaaaaaa

SEQ ID NO: 202 - protein, 233 aa, Zea mays
MAPRTSEKTMAPAAAAATGLALSVGGGGGAGGPHYRGVRKRPWGRYAAEIRDPAKKSRVWLGTYDTAEDAARAYDAAAREYRGAKAKTNFPYPSCVPLSAAGCRSSNSSTVESFSSDAQAPMQAMPLPPSLELDLFHRAAAAATGTGAAAVRFPFGSIPVTHPYYFFGQAAAAAAEAGCRVLKLAPAVTVAQSDSDCSSVVDLSPSPPAAVSARKPAAFDLDLNCSPPTEAEA

SEQ ID NO: 203 - DNA, 1002 bp, Oryza sativa
cttacaccattcccaatccccaccgcctcgattccgattcccatctcctcgattcccgagcttggcgcgggcatgcgtcgcggcggcgcggcggaggaggacgcggaggcggcgaggttccgcggggtgcggaagcggccgtgggggaggtacgcggcggagatccgcgacccggcgaagaaggcgcgggtgtggctggggacctacgactccgccgaggacgccgcgcgcgcctacgacgcggcggcgcgggcgctgcgcggggccaaggccaagaccaacttccccctctccctcccccacgcccaaccccagctccaccaccaccaccaccaccacctcacctaccccgccgccgctgttgtcgccgctaggccggccactagcagcctcagctccaccgtcgagtcgttcggcacccggccgcggccggtgctcccgccgcggccgcccccgccgccgccgatccccgacggtgactgccgcagcgactgcgggtcgtcggcgtcggtggtggacgacgactgcgcggacgccgccgcctcgccctcgtgccggctcccgttccagttcgacctcaacctgcctcctggtggaggcggcggcggcggcggcggctttggctgtgcctacgacgacgaggagctgaggctgacggcgctgcggctctgagcccccaaccccaccggtcgttggagaaagaggaaaaggagaaaaatatttggttcttcccttctctcgtagccgacatgatccttccgcgctttgtgttgttcttgtttacttgatctgatgatgattaatgtggcccgatctgcgtatctgcctgcttgctgctggcgatagatgatgattgctgcgtctcgcagcagctcgctgtggttgtgctgttgtaatatagcaacattttacttgcttccttcctgtgaggaagcagacagctaaagtaacttattttcaatctttagctacaaaaaaaaaaaaaaaaaaaaaaaaaaaaaa

SEQ ID NO: 204 - protein, 223 aa, Oryza sativa
LTPFPIPTASIPIPISSIPELGAGMRRGGAAEEDAEAARFRGVRKRPWGRYAAEIRDPAKKARVWLGTYDSAEDAARAYDAAARALRGAKAKTNFPLSLPHAQPQLHHHHHHHLTYPAAAVVAARPATSSLSSTVESFGTRPRPVLPPRPPPPPPIPDGDCRSDCGSSASVVDDDCADAAASPSCRLPFQFDLNLPPGGGGGGGGGFGCAYDDEELRLTALRL

SEQ ID NO: 205 - DNA, 1113 bp, Oryza sativa
ccaccaccccctcatccgcaacaccgcagctgcacccgcatccgcaccgcaccatcagcgcgcaccaagaaagaaacacggagaaaagaaagatcgccatggcgccgagaacgtcggacaagactatgtcaccggcggccgcggccaccggactcgcgcttggcgtgggcggtgtcgccggagccgccgccgtgggcaccggccagcacttccgtggcgtgaggaagcggccgtggggccgttacgcggcggagatccgcgacccggccaagaagagccgcgtgtggctcggcacgttcgacacggccgaggaggccgcgcgcgcctacgacgccgcggcgcgcgagtaccgcggtgccaaggccaagaccaacttcccctaccctaacggcgcgcccgccgccggtgtgaacagcggcagcagcaacagcagcaccgtcgagtcgttcggcagcgacgtgcaggcgcccatgaaggccatgccgatcccgccgtcgctcgagctcgacctgttccaccgcgccgcagcggccgcggccgccggcgcaggcggcatgcgtttccctttcgagggctaccccgtatcgcacccttactacttctttggacaagcggccgccgccgccgccgcctctggttgccgcatgctcaagattgcgccggcgccggtcaccgtggccgccttggcacagagcgactccgactcctcgtcgatcgtggatctggcaccatcaccgcccgccgcgttggcgaagaaagccatcgcttttgatcttgatctgaactgtccgccgccgatggaggtctagcagccggagtttttacatgatgaccgctagttcatttatttctttttaatttttagtagtagaaaaattccgtgtacctcttatgcctagaccctcttgcttaactgagggaagacatttttgtaaatagtttttttcgccggcgatgtagtttaagagaagatcacaccatgtgtgtcacctaagacatatcctgccggcgttgttatggagcgggattatatatgtattattattattttgatagtcatgagaaactatgtagaaacccttctaagaaaaaaaaaaaaaaaaaaaaaaaaaa

SEQ ID NO: 206 - protein, 268 aa, Oryza sativa
TTPSSATPQLHPHPHRTISAHQERNTEKRKIAMAPRTSDKTMSPAAAATGLALGVGGVAGAAAVGTGQHFRGVRKRPWGRYAAEIRDPAKKSRVWLGTFDTAEEAARAYDAAAREYRGAKAKTNFPYPNGAPAAGVNSGSSNSSTVESFGSDVQAPMKAMPIPPSLELDLFHRAAAAAAAGAGGMRFPFEGYPVSHPYYFFGQAAAAAAASGCRMLKIAPAPVTVAALAQSDSDSSSIVDLAPSPPAALAKKAIAFDLDLNCPPPMEV

SEQ ID NO: 207 - DNA, 1089 bp, Oryza sativa
ggcacgaggttctaaccacacacccaaacccaacctcccaaaacacccacccggtttaccagagatccgcgcccgccacttgtaaacctgctgcacccatggcgcccagagcagctacggtggagaaggttgctgtggcgccacccaccgggcttggtcttggcgtcggcggaggtgtcggagccgggggtcctcactacaggggcgtccgcaagcgcccgtgggggcgttacgcagcggagatccgtgaccctgccaagaagagccgggtgtggctcggtacctacgacacggcagaggaggccgcccgcgcctacgacgccgccgctcgagagttccggggtgccaaggcaaaaacaaactttccgtttgcatcacagtcgatggtcggctgtggcggcagccccagcagcaatagcacggtagacaccggtggcggcggggttcagacgcctatgcgggccatgcctctgccgccgactctggacttggatttgttccaccgcgcggctgctgtgactgcagtcgccggcaccggcgttcgctttcctttcagaggatatcccgttgcacgtccagcaacgcatccttactttttctatgagcaggctgcagcggctgccgcagctgaggctggataccgtatgatgaagcttgcaccgccggtcaccgtggcggcggttgcacaaagtgactccgactcctcgtcggtggttgatctcgcgccgtcacctccagcggttacggcgaacaaggcggcagctttcgatctggatctgaaccggccgccgccggtagagaactagctcaggatgggttagctgacgactttgtagtttctctcttattttcttctttgatggatatttctctccgatgttttggtcctctgtgtttttgtttagtagcctgtgagagacggaagagccttgtaaatagtttttctgccgagggcgaaattcatcttgggatctgttaattagaacagatcatgccggcgatgagatggactaaaccgtggagtgtatgtattcctttatattagtatgaagaaattattcagaaagtcacaaaaaaaaaaaaaaaaaa

SEQ ID NO: 208 - protein, 265 aa, Oryza sativa
VLTTHPNPTSQNTHPVYQRSAPATCKPAAPMAPRAATVEKVAVAPPTGLGLGVGGGVGAGGPHYRGVRKRPWGRYAAEIRDPAKKSRVWLGTYDTAEEAARAYDAAAREFRGAKAKTNFPFASQSMVGCGGSPSSNSTVDTGGGGVQTPMRAMPLPPTLDLDLFHRAAAVTAVAGTGVRFPFRGYPVARPATHPYFFYEQAAAAAAAEAGYRMMKLAPPVTVAAVAQSDSDSSSVVDLAPSPPAVTANKAAAFDLDLNRPPPVEN

SEQ ID NO: 209 - DNA, 522 bp, Glycine max
  unsure (456): n is a, c, g or t
  unsure (518): n is a, c, g or t
cccacacgcttcttactcctctcataacttttctgctccccgttgagaaagatttgaatccaaaggaaaaataacgctaatggctccaagagacagccgagccaccgcgctcattgggcccggcccaagcctatcaccggcccacaaagagatccgctacagaggcgtcaggaaacgcccctggggccgctacgccgccgagatccgcgatcccggcaagaaaacccgcgtctggctcggcactttcgacaccgccgaggaagccgcgcgcgcctacgacaccgccgcgcgtgagtttcgtggcgccaaggccaagaccaatttcccgacaccctcggaactcatccttaacaacaacaacataaacgctcgtagtccccagccagaccagcaccctcggactcatcctctcccccgccaccggccaccgctagaccttaccctcaaccctctctncctccggctgttcttcccggtgggcgcggtcctgttcctattcttcgacgcattcgcgcgtngcgg

SEQ ID NO: 210 - protein, 130 aa, Glycine max
  UNSURE (126): Xaa can be any naturally occurring amino acid
MAPRDSRATALIGPGPSLSPAHKEIRYRGVRKRPWGRYAAEIRDPGKKTRVWLGTFDTAEEAARAYDTAAREFRGAKAKTNFPTPSELILNNNNINARSPQPDQHPRTHPLPRHRPPLDLTLNPLXLRLF

SEQ ID NO: 211 - DNA, 1531 bp, Glycine max
gcacgaggaaagtatcactactgttactatttttggttttctattttatcacatacacatggaggaagcaatgaggcgtctcaacggggtagctccgattatcggacccgactcgaaaggcgacggtggactcatcgccaataacccgaaacggacctcggccgtgaacaagagggctttaagagaagacggcggcggtggtggcggcggcggagcgatgaggtaccgcggcgtgaggcgcaggccgtgggggcgttacgcggcggagataagggaccctcaatcgaaggagcggcgatggctgggaaccttcgacacggcggaggaagccgcttgcgcctacgactgcgctgctagagccatgaggggtctcaaagctcgcaccaacttcgtttacccaacttctccgcaaccttcttccgccaccaccgaacacttgttccctaacttcaacaacaacaacaactttcacaaacactcactcttcaatcaccaccgtaaccgccacataaccggttccaacacttgttttgaccaccctcactccgttgacttttcagcccctcgaaacccttcttctctcaacatgcttctctttcgtgaccttattcactctaacccttctttgctttcttcttcttccactcagaacttccacgaccagttttacaacaagagtacttctactttttcatcgttacctgtttctccttctcttgctccccctagttattcgatgaataattcttgtggaggctctttgtctgttaagatgaacacgtttcccacttgtggaactaattttgctgaaaaaggtgatgatggtgatggttttttctctcgtgagtcttcggattcggggttgttggaggagatagttaacaagttcttgcctagaacgaagcctagtaaatgcgagactacttttgcaaatcctcaggaggagtcgcttcttctccctccgcttgtttctgaatcaacgcttgtttccaccgggcaacaatactatgatgatgacatgaaaaaagggtttccaaagaacgagggtctaggtgttttttattctgatcaaggttttcccatgcagcaattcgacacctctaatgggtttaatagcatggctatggagaatgatcaaaacattattaataatgcagagaactgtgtcgttgaagatgtttttcagtaccaagagcttcttaatgctttcgcaatcagaatgcaaaatgcttaattagttaacatttccagtgtctgcatctcaatgctagttgtgtatgtagtcatgttgaatctgtcacttctcaatgttggtctggcctttcaattagaaacttattaatcattagggccttttgttcctaggtttaattaaccaggttattttgttcgtgcttactatgtagtattatgcccctctggcttccttccagtagtattatgtatggaactatggataatttgaaagcaatatatttttagtattggtattttgggtaaaaaaaaaaaaaaaaaaaaaaaaaaaaaaaaa

SEQ ID NO: 212 - protein, 391 aa, Glycine max
MEEAMRRLNGVAPIIGPDSKGDGGLIANNPKRTSAVNKRALREDGGGGGGGGAMRYRGVRRRPWGRYAAEIRDPQSKERRWLGTFDTAEEAACAYDCAARAMRGLKARTNFVYPTSPQPSSATTEHLFPNFNNNNNFHKHSLFNHHRNRHITGSNTCFDHPHSVDFSAPRNPSSLNMLLFRDLIHSNPSLLSSSSTQNFHDQFYNKSTSTFSSLPVSPSLAPPSYSMNNSCGGSLSVKMNTFPTCGTNFAEKGDDGDGFFSRESSDSGLLEEIVNKFLPRTKPSKCETTFANPQEESLLLPPLVSESTLVSTGQQYYDDDMKKGFPKNEGLGVFYSDQGFPMQQFDTSNGFNSMAMENDQNIINNAENCVVEDVFQYQELLNAFAIRMQNA

SEQ ID NO: 213 - DNA, 1036 bp, Glycine max
cacgcttcctactcctctctttcaccacttttctgctccccgttgagaaagaatttgaatcatcaaaatcaaaaacacgcaccaacaatggccccaagagacagccgagccaccgcgttcgccggcccaggcccatcaccggcccacaaagagatccgctaccgaggcgtccggaaacgcccctggggccgctacgctgccgagatccgtgaccccggcaagaaaacgcgcgtctggctcggcaccttcgacaccgccgaggaagccgctcgcgcatacgacaccgccgcgcgtgagtttcgcggtgccaaggccaagactaattttccgacaccttcggaactcatccttaacaacaacattcgtagtcccagccagagcagcaccctcgactcttcctctcccccgtcaccgccaccgccgcttgaccttaccctaacccctctctccgtggccgccgccgtcttcccggtggctcgtccggttctattttttgacgcgttcgcgcgtgcggacgccatgatcgccgtctcccgccgcgagacgtgcggcttcgagcgccccgccgctgatttccgccgtaacgactccgattccgattacaaccgccgcgtgctcctggatcttgacctgaacgtgcctcctctccctgaggttgcctgattcatgcagggagatctggttttccgcaatttttttcgtactacctttttaagcatctgggaacactactacgcatttttttgtgacgaaattgctctcgagaaattatagtgttacggagagggagcagcagctaagtgtgagtagtggatgacatgatgctcggaattgttgttgaccattttgtgatgaagatataatcggcacgttatgtaaatacacgttataaccgaaaagcaaacgcgctttttcttgcttttttttgcaactgagaacttaacagagtatctcatggttgtttctgtaatttctcaaaatatataaatatttccatttccatccttttattattaacaaaaaaaaaaaaaaaaaa

SEQ ID NO: 214 - protein, 220 aa, Glycine max
HASYSSLSPLFCSPLRKNLNHQNQKHAPTMAPRDSRATAFAGPGPSPAHKEIRYRGVRKRPWGRYAAEIRDPGKKTRVWLGTFDTAEEAARAYDTAAREFRGAKAKTNFPTPSELILNNNIRSPSQSSTLDSSSPPSPPPPLDLTLTPLSVAAAVFPVARPVLFFDAFARADAMIAVSRRETCGFERPAADFRRNDSDSDYNRRVLLDLDLNVPPLPEVA

SEQ ID NO: 215 - DNA, 837 bp, Vernonia mespilifolia
cttttttctcattacccatggctcctcgcgataaacctgacgccaccaccgccgccgctaatggcgccaaagagtctcgctttcgtggtgtccgtaagcgcccttggggacgttatgcggccgagattagagatcccggtaagaaaacccgtgtttggcttggtactttcgatacacccgaggaggccgctcgtgcttacgattccgccgcccgtcagtttcgtggcgctaaagccaaaactaacttccctttccatacggatttggttcttccgaccgccgtcaaaggcgtggccaggagccctagcgagaatagcatcgttgaaacgccgatccccgcagctccgcttccgcctgaagcactggaccttagcctgtcgcattattccgttggatttccgatggctcgttcgttgctattgtatcattcacagcaggtgaataacaaccgtctcagatcggacagattggtcgtccgcgatcccaaactaaacgtcggtgccggtggcgtcgttcagagtgattccgactcctcctcacaggtgatcaattatagttatcattcggtgcgtccaaaacaagagaaatccctaactttggatctggatctgaattttccaccaccggaagttgcctgatgatttcttctttttgtttagatcagatttaacaaaggcaaaaaagtgttaggagtagtgcaggctgcctgataatgttttgatgataaatgcttctatgattttgtacatacatcaaaggaaaggaaaaaccacacagatttcctttgatttttgcatctaaaaaaaaaaaaaaaaaaaaaaaaaaaaaaaaaaaaaa

SEQ ID NO: 216 - protein, 211 aa, Vernonia mespilifolia
FFSLPMAPRDKPDATTAAANGAKESRFRGVRKRPWGRYAAEIRDPGKKTRVWLGTFDTPEEAARAYDSAARQFRGAKAKTNFPFHTDLVLPTAVKGVARSPSENSIVETPIPAAPLPPEALDLSLSHYSVGFPMARSLLLYHSQQVNNNRLRSDRLVVRDPKLNVGAGGVVQSDSDSSSQVINYSYHSVRPKQEKSLTLDLDLNFPPPEVA

SEQ ID NO: 217 - DNA, 817 bp, Triticum aestivum
cccaccccacccccccaccccgcatcaccaaaacgcccgcataaccaaaaagatacgcgcacgccacttatacacctgctgcacccatggcgcctagagcggcggagaaggcgcctgtctccccgcccaccgggctcggcctcggcctcggcggcggggtcggggtcgtcgccgggggcgcgcactacaggggcgtccgcaagcgcccgtggggacgttacgccgcggagatccgtgacccggccaagaagagcagggtgtggctcggcacgtacgacacggcggaggaggccgcgcgcgcctacgacaccgccgcgcgtgagttccgcggcgccaaggcgaaaaccaacttcccgttcccttcgtcgtcgtcgtcgtcccctgtcgccggcgccggcggcggcggcagcccgagcagcgacagcaccttggactcgagcggcggagggagcggcggctgcgcccaggcgcccatgcaggccatcccgctgccgcccgccctcgacctggacctcttccaccgcgcggcggccgtcacggcggtcgccggcggcggcatgcgcttcccattcaacggttacccggtggcgccgcgccagcccatgcacccgtacttcttctacgaacaggccgcagcggcggcggcggcggcgtcggggtaccgcgcgctgaaggtggcgcagccggtcaccgtggcggccgttgctcggagcgactccgactcctcgtcggtcgttgatctgtccccgtcgccccccgcggtgacagcgcataaggcggtcgcgtttgatctggatctgaaccggccgccgccttc

SEQ ID NO: 218 - protein, 246 aa, Triticum aestivum
MAPRAAEKAPVSPPTGLGLGLGGGVGVVAGGAHYRGVRKRPWGRYAAEIRDPAKKSRVWLGTYDTAEEAARAYDTAAREFRGAKAKTNFPFPSSSSSSPVAGAGGGGSPSSDSTLDSSGGGSGGCAQAPMQAIPLPPALDLDLFHRAAAVTAVAGGGMRFPFNGYPVAPRQPMHPYFFYEQAAAAAAAASGYRALKVAQPVTVAAVARSDSDSSSVVDLSPSPPAVTAHKAVAFDLDLNRPPPSED

SEQ ID NO: 219 - DNA, 859 bp, Triticum aestivum
gcacgaggcttcattctccctcgttccatccaagctccaccatccatcactgatttgcacttacctagctactccgcaacccccacttccggcttcttcatttctcactactagtacgtagttgagattatggagggcggagaaggatccggtggcggcggcgagccgaccaagtaccgcggggtgcgccgcaggccgtggggcaagttcgccgcggagatccgggactcgagccggcacggcgtgcgcatgtggctcggcaccttcgacaccgccgaggaggccgcggccgcctacgaccgctccgcctactccatgcgcggccgcaacgccgtgctcaacttccccgaccgggcgcacgtctacgaggccgaggccaggcgccagggccagggctcttcgtcgtcggcgaggcagcagaatcagcagcagcagcaggggcagagcggggtgatcgagttcgagtacctggacgacgacgtgctgcagtccatgctccacgaccacgacaaatccaacaagtagatcgatggatcatccatccatccatccatggatcgatccataatacctactgtatcatcccggcccggccggcaacatcgacctgcgtgcatgcgcgggcgcggatgcaatctacactacctacctatgcattccggccatatattaggtacgtagattatatgtgtacgagagcctacgagctcgatgaagatcgtacgtggtgcattctgatgcatgaggattccatcgacacgaccctctaccatatatttgatgggtcgatcgagtaatttgcagccagtaatccaatcgatgatatggggttttcaaaaaaaaaaaaaaaaaaaaaaaa

SEQ ID NO: 220 - protein, 131 aa, Triticum aestivum
MEGGEGSGGGGEPTKYRGVRRRPWGKFAAEIRDSSRHGVRMWLGTFDTAEEAAAAYDRSAYSMRGRNAVLNFPDRAHVYEAEARRQGQGSSSSARQQNQQQQQGQSGVIEFEYLDDDVLQSMLHDHDKSNK

SEQ ID NO: 221 - DNA, 494 bp, Dimorphotheca sinuata
  unsure (417): n is a, c, g or t
  unsure (470): n is a, c, g or t
  unsure (490): n is a, c, g or t
aatcaatgcagcagcacatgcacatctgaacagttttctctctctaacttcttctctttgatctagagagagaaagtgtagagagagaaagaggaaatggcgatggttgacgatcaatcggaaacttgcctcgtcatcggaggcagaaatagcttccttgggagatgtcttgttgttaggttattgaagctaggtcattggatcgtccgagttgccgattccactcactcactccaactcgatctctccgatcataactatgacttgcctctaaatcaagctctctctactggccgtgcttcctatttccattttgatgtgcaaaacactaattccatcatcaatgctattgaagggtcatcaagttgggttttatgtgggatgaagatgattactgcaatctcgaattcctttccngggtacacgataaattggtcaaaggcgtgaaaaatggcaacaatggcttgtcnaagaatgcaacaattaaacnggtt

SEQ ID NO: 222 - protein, 99 aa, Dimorphotheca sinuata
MAMVDDQSETCLVIGGRNSFLGRCLVVRLLKLGHWIVRVADSTHSLQLDLSDHNYDLPLNQALSTGRASYFHFDVQNTNSIINAIEGSSSWVLCGMKMI

SEQ ID NO: 223 - DNA, 727 bp, Zea mays
  unsure (559): n is a, c, g or t
  unsure (655): n is a, c, g or t
  unsure (675): n is a, c, g or t
  unsure (700): n is a, c, g or t
  unsure (710): n is a, c, g or t
  unsure (718): n is a, c, g or t
  unsure (725): n is a, c, g or t
tttccatatggctgctccagattcatccatcaacaacttccaccttcattatggagtcaatgtcgatggaacaaagaatgttattgacacttgtatccgttgcaaggtgaagagactcatctatactagttcacctagtgtcgtgtttgatggagttcatggaatttttaatgcagatgaatcaatgccttacccagataagtttaatgattcatattcagaaacgaaagcggatgcagaaaagcttgtgatgagagctaatggtagggaagggcttcttacatgctgtatacgcccaagtagcatttttggccctggtgataagctaatggttccatctttggttgctgctgcaagggcagggaagtccaaatacattattggtgatgggaacaactactatgatttcacctacgtggaaaatgtggcatatggccatgtttgtgcagagaaaactctatcatctgaagatggtgcaaagatagccgctggaaaaacctatttcataacaaatatggagcctataaaattctgggagttcatgtcattgattttagangctggatatgaaaggccttcagtaaaatacagtctctgtatgatgcagtgctcatgttgtgaatgacttacagaattgcaagttgaatgaagtccnagtgacccttcaaggtcagntgcttcatgtacaggcatcagtgcnaagacaaggncacttgtntgacccngt

SEQ ID NO: 224 - protein, 201 aa, Zea mays
  UNSURE (186): Xaa can be any naturally occurring amino acid
FHMAAPDSSINNFHLHYGVNVDGTKNVIDTCIRCKVKRLIYTSSPSVVFDGVHGIFNADESMPYPDKFNDSYSETKADAEKLVMRANGREGLLTCCIRPSSIFGPGDKLMVPSLVAAARAGKSKYIIGDGNNYYDFTYVENVAYGHVCAEKTLSSEDGAKIAAGKTYFITNMEPIKFWEFMSLILXAGYERPSVKYSLCMM

SEQ ID NO: 225 - DNA, 705 bp, Zea mays
  unsure (351): n is a, c, g or t
  unsure (390): n is a, c, g or t
  unsure (499): n is a, c, g or t
  unsure (530): n is a, c, g or t
  unsure (535): n is a, c, g or t
  unsure (564): n is a, c, g or t
  unsure (620): n is a, c, g or t
  unsure (631): n is a, c, g or t
  unsure (634): n is a, c, g or t
  unsure (660): n is a, c, g or t
  unsure (668): n is a, c, g or t
  unsure (684): n is a, c, g or t
  unsure (688)..(689): n is a, c, g or t
  unsure (697): n is a, c, g or t
gtgcgtgctgcgacctagcaatcttttcggttccgggtgattccagcttggtgaggtttgttgctggatatgcaaggtctcccttgggcaagtttgtaataggcagtggcagtaacatgtctgactttacctatgtggaaaatgtggcccatgccaatatttgtgctgagcaagccttgtcttcaaatgcagcttctgtagctgggaagcccttttttgttaccaatgacgaacctatggaaacatgggagtttatgaattgcatgatggaagccatgggttgtcagaggcccaggattaacctcctgccaagatgttattgtttgcagccttgttctccaaaatgatcancacaggcttgggtttcaaatgcttccaccctcttctcanccagatacaatatactcctgtccgtgtacgagaactttaacacttcaagaccaagaagattactggatacaaccaatgtacatgggaggatggattatgagatctgggnattcaaaacacagaaattggggtgcaaaaanaggcncgtggtctcaagaaataacgcaggatganactgcgaatctcttgaggataaaaaccttattgaatatgtcgcttcaggtccgctnaaaaatttttncangcaatttcagcccctgcctacagggngcccaaantggttacaagcacgtnttannccccatgnacctttgg

SEQ ID NO: 226 - protein, 91 aa, Zea mays
PGDSSLVRFVAGYARSPLGKFVIGSGSNMSDFTYVENVAHANICAEQALSSNAASVAGKPFFVTNDEPMETWEFMNCMMEAMGCQRPRINL

SEQ ID NO: 227 - DNA, 422 bp, Hevea brasiliensis
ctctacgctacgctctctctctctctctgattatatcgatttcgttttctctctctctctctgtggtcgttaatggcgatcgaggttccatttggggatttaaaccctaagacctgcgcggttcttggagggcgagggtttctaggaagatcgctcgtcttcaccctccttaaactgggtaactggatcgttcgagtctccgattcccctcactctttgcaactccacctcactgactcttctgactcctttcttaacgacgccatctcttccggccgtgcttcctgccatcgtcttgatgttctcgacgtctcttcaatcgtcaaagctattgagggtgcatctgtagtattttatatggaagctactgatttatggaatcaagaattctaatattgctacaaaattatagttcaaggggg

SEQ ID NO: 228 - protein, 116 aa, Hevea brasiliensis
  UNSURE (107): Xaa can be any naturally occurring amino acid
MAIEVPFGDLNPKTCAVLGGRGFLGRSLVFTLLKLGNWIVRVSDSPHSLQLHLTDSSDSFLNDAISSGRASCHRLDVLDVSSIVKAIEGASVVFYMEATDLWNQEFXYCYKIIVQG

SEQ ID NO: 229 - DNA, 757 bp, Zea mays
  unsure (8): n is a, c, g or t
  unsure (67): n is a, c, g or t
  unsure (698): n is a, c, g or t
  unsure (709): n is a, c, g or t
  unsure (752): n is a, c, g or t
gcggactnttgggcggacgcgtgggcgcgggtccgaggtcaggcagcagcagcacggagtagcaccngggcgaccgcccaggttatcgtcggccgccggcgacctgtaccccggcgaggagatgcatctgagcgcgaacgaggggatcgagggtctgcgattcgcggtgacgggcgggcagggcttcgtcggagctgccctcagcctcgagctgctccgccgcggtgcccgcgaggtccggtccctcgatctccgcgcctcctcctcctggtcccagcagctcctcgacgccggcgtccgaatcatccaaggggacataagaaagaaggatgatgtgcggagggctttccgtggagtggactgtgttttccaccttgcttcttatggcatgtcagggaaggagatggtgcagactgcgagatctgatgaggttaatataaatgggacctgcaatgtactggacgcttgccatgagcaaggtgtcagaaggcttgtgtatgtaagcacataccatgtggtatttggaggaaagccgattgtcaacggaaatgaagcgttgccttattttccgattgaagaccatgttgatgcttatgggcgcagcaaatcaattgctgaacaagctgtactgaagagtaacgggccgggcagctaaaatgataaaagtagcgctttttcatgggcaattgcctggtgtnttatggccagngaaaagggatttcaaaatctggccttgaagtggataacttttnaaatg

SEQ ID NO: 230 - protein, 176 aa, Zea mays
MHLSANEGIEGLRFAVTGGQGFVGAALSLELLRRGAREVRSLDLRASSSWSQQLLDAGVRIIQGDIRKKDDVRRAFRGVDCVFHLASYGMSGKEMVQTARSDEVNINGTCNVLDACHEQGVRRLVYVSTYHVVFGGKPIVNGNEALPYFPIEDHVDAYGRSKSIAEQAVLKSNGPG

SEQ ID NO: 231 - DNA, 504 bp, Glycine max
  unsure (477): n is a, c, g or t
gttaatcagaaatcagaatgcacttgagcgagaacgaagggatagaggggaaggccttcgtggtcaccggtggactgggattcgtaggatctgctctctgcttggagctcatccgaagaggtgctagagaggtgcgagcctttgacctccgcctctcttctccatggtcgcgtcctctcaaggtcaagggagtcctttgcgtccaaggggatgttgcccgcaaagaagacgtggaaagggtcctccgcggttccgactgcgtattccaccttgcggccttcggaatgtcaggcaaagagatgctccaatttggtcgcattgatgaagtcaacataaatgggacttgccatgttatcgatgcttgcctccacctcggcatcaaaaggcttgtctactgtagcacaaacaatgttgtctttggcggtcaacagatcatcaacgggaatgagacattgccctaattcccaaattgatcancaagtccattcaaatgggcgcagtaaa

SEQ ID NO: 232 - protein, 147 aa, Glycine max
MHLSENEGIEGKAFVVTGGLGFVGSALCLELIRRGAREVRAFDLRLSSPWSRPLKVKGVLCVQGDVARKEDVERVLRGSDCVFHLAAFGMSGKEMLQFGRIDEVNINGTCHVIDACLHLGIKRLVYCSTNNVVFGGQQIINGNETLP

SEQ ID NO: 233 - DNA, 884 bp, Triticum aestivum
  unsure (739): n is a, c, g or t
  unsure (789): n is a, c, g or t
  unsure (880): n is a, c, g or t
cagatattttattgccggaaaatgcataatgctaataatttagcgcggcactgaaacacctccacggccttgatgctcacttgacaattgaaaaacgcatcatcatcctagaccgcaatcctgtttaaacggtgatcaatataaacgggacgtgcaatgtactggatgcttgccatgagcatggtgtcagaaggcttgtgtatgtaagcacatacaatgtggtgtttgggggaaagccaattgtcaatggcagtgagacgttgccttattttcccatcgaagaccatgttgatgcttatgggcgtagcaaatcgatagctgaacagttggtgctgaagagcaatggtcggcaagctaagagtaataaaggtacccgtctttatacatgtgcaatacgcccggctgctatctatggtccaggtgaagagcgtcatcttccaagaatcctgtctcttggaaaattgggattagcatctttcaggattggggctccaaatgtgaagacagattgggtctatgctgataatcttgttcttgcactgatattggcaagtatgggccttttagatgacattcctggcaggaagggaactcctgtagcagctggtcaagcatacttcatatgtgatggagcgcctattaatagtttcgattttatcatcagtcccttatttcgaagtttgggctatgctgttcctcgaagttacactagatacctctgttgccctcgcaatttcangaatcattttgttcatgtccacactactctatccatgggttagatagtanatggattcctcagcctcttattctcctgctgaagtatacaaggtaggtgttacacattacttttcatatctgaaagctaaagaggactcgntacg

SEQ ID NO: 234 - protein, 175 aa, Triticum aestivum
ININGTCNVLDACHEHGVRRLVYVSTYNVVFGGKPIVNGSETLPYFPIEDHVDAYGRSKSIAEQLVLKSNGRQAKSNKGTRLYTCAIRPAAIYGPGEERHLPRILSLGKLGLASFRIGAPNVKTDWVYADNLVLALILASMGLLDDIPGRKGTPVAAGQAYFICDGAPINSFDFI

SEQ ID NO: 235 - DNA, 1732 bp, Zea mays
gcacgagggcctgtttgcagcagcaagcgttcaagaaatcaagcggccgcctcgtcccctccgcgcccggcgcctccgacgcccaagcagcgtgaccgtggaagggacgaagaagagcaccctcaagcggccgcactaatcccaaaccggcctccgacccccaagcagcctcacgctgctcgatggcggcgccgtatcaccagcctacgagcctggaggaggtccgcactctgtggatcggcgacctccagtactggaccgacgagaactacctctacagctgcttcgctcacaccggggaggtacaatctgttaaaataatacgcaacaaagtaacaagccttcctgagggttatgggtttatagagtttgtttcacatgaagctgctgagaaaattctccagacttacaatggcacacagatgcctggaactgaacacacattcagattgaattgggcctctttcagctctggtgagaggcgccctgatccaggatctgatcattcgattttcgtaggggacttggcacttgatgtcacagattacttactacaggaaacattccgagtgaactattcatctgttagaggtgctaaggttgtcacggatccaaataccgggagatctaaaggatatggatttgtaaagttcgcagatgaaaatgaaaagaaccgtgcaatgacagaaatgaatggtgtgtactgttcaacgagacctatgcggataagtgctgcaatacctaagaaatccactggctctcagcttcagtattcagctgctaaagcggtgtatccagcaacagcgtatgcaatgcctcagctccaggcagttctccctgacagtgatcctacaaacactacgatatttattgggaatttggacccaaatgtgatagaagatgagctgaggcagatatgtgtacagtttggagaacttatatatgtgaaaattcctgttggtaaaggatgtggttttgtacagtatgcatctagggcatcagctgaagaggcagtacaacgtcttcatggcacaatgattggccaacaagctgttcggctttcatggggccgaagtcctgcgagtaaacaggattcatcagctgtgtggagtcagcaagcagatccaaatcagtgggcaaacacttactatggctatgggtatgatgcatatggatatgctcaggatccgtcatacgcttatggtgcttatgcaggatatagccaatatccccaacaggttgagggaactgttgacgccacttctgttgctggtagccatccaggcatggagcaaaaggaggagccatatgatccaatgaacatacctgatgttgacaagttgaatgcttcatacatggctgttcatggtagagccatgctagggcggtccttgtggttgaagaccaacccgctgccccaaccgacataagcatgtttcctcccccgaagactacagccagtgctggtgggcgcagctgggtttcatcgcgcagatgattttgcccttcccagtagtcacgttaaactctgaaattgttgtaggctggccagcagcttcgtctatattgagaacattcgatgtatgataggcgtgactcttttgtactgtatttcttaggctgttggttaatattattaggacaatattgagggagcggtgaaagtcaactgtctgtatttccaactgattattctgctgttcgatactcaaaaaaaaaaaaaaaaaaaaaa

SEQ ID NO: 236 - protein, 415 aa, Zea mays
MAAPYHQPTSLEEVRTLWIGDLQYWTDENYLYSCFAHTGEVQSVKIIRNKVTSLPEGYGFIEFVSHEAAEKILQTYNGTQMPGTEHTFRLNWASFSSGERRPDPGSDHSIFVGDLALDVTDYLLQETFRVNYSSVRGAKVVTDPNTGRSKGYGFVKFADENEKNRAMTEMNGVYCSTRPMRISAAIPKKSTGSQLQYSAAKAVYPATAYAMPQLQAVLPDSDPTNTTIFIGNLDPNVIEDELRQICVQFGELIYVKIPVGKGCGFVQYASRASAEEAVQRLHGTMIGQQAVRLSWGRSPASKQDSSAVWSQQADPNQWANTYYGYGYDAYGYAQDPSYAYGAYAGYSQYPQQVEGTVDATSVAGSHPGMEQKEEPYDPMNIPDVDKLNASYMAVHGRAMLGRSLWLKTNPLPQPT

SEQ ID NO: 237 - DNA, 1627 bp, Zea mays
ctggatcagaaggcaacctcagcggccgcaagcccgcaactttatccatccgtttggcccacgcgctccgcagtctcctctctcctcgggtggctagggttttgactcctagtcctaaaccagctcccacgccgccatgatgcagccgccgccgccacatcagcagcagcaatgggcaatggcgcccccgcccccgccgcagtactaccaggcggggcaccctccgccgccgcccccgcagttctaccaggcgggccctccgcctcccgctatgtggggccaaccgccaccgcaggcggcggcggcgccggcgccggccggcggcggggcgggggacgaggcgaggaccctctggatcggggacctgcagtactggatggatgagaactacctctatagctgcttctcccaggctggcgaggttatttccgtgaagataattcggaacaagcagactgggcaacctgagggttatggttttattgaattcagcaaccatgctgtagccgaacaagttctgcagaactataatggtcaaatgatgcccaatgttaatcaacctttcaaattgaattgggctaccagtggggctggtgagaaacgtggagacgatggttcagattatactatatttgttggggacttggcctcggatgttacagatttcattctacaagatacgttcaagagtcgttatccatcagttaagggtgcaaaagttgtctttgacagaactactggccgttcgaaaggctatggttttgtaaagtttgcagattcggatgaacagacacgggcaatgactgaaatgaatggacaatactgttctagcagggccatgcgccttggaccagcatccaacaagaagaatactggtggaccacaaccatcgagtgctatttaccagaacacccaaggaactgattctgatagtgatccgaacaatactactgtatttgttggcggccttgacccgagtgtgactgacgagcttctgaagcaaactttcagtccatatggagagcttctctatgtcaaaatacctgtaggaaagcgctgcggatttgtccaatattctaacagggcatcagctgaggaggccataagggtgctaaatggaagccagttgggaggtcagagcataaggctctcatggggccgtaaccctgcaaacaagcagcctcagcaagagcagagccaatggagcggtggtggctattatgggtatccccaaggatacgatccatatggctatgctcggccccctcaagatcctgccatgtacgcctacgcagcatatccagggtatggaaattaccagcaacagccaccacagcagcccccgccacaacagtaatgatgtcccgagagtgatcatttgcaagctggtcgcaaagtagctggggggttggggcgcagcaactttggtgcgttggcatgagaaattttgcggcggttgcttgtgttgtgttgtattgttccgacgcccttgtacacgtagcctgtgttgtaactgaatttttgccgaggccttatgagtgactagtgtttcaactgtaactggattgcacatttttgtcgcaaggaatgtactattattgtgtggctcgtgccgctttgaacgctg

SEQ ID NO: 238 - protein, 406 aa, Zea mays
MMQPPPPHQQQQWAMAPPPPPQYYQAGHPPPPPPQFYQAGPPPPAMWGQPPPQAAAAPAPAGGGAGDEARTLWIGDLQYWMDENYLYSCFSQAGEVISVKIIRNKQTGQPEGYGFIEFSNHAVAEQVLQNYNGQMMPNVNQPFKLNWATSGAGEKRGDDGSDYTIFVGDLASDVTDFILQDTFKSRYPSVKGAKVVFDRTTGRSKGYGFVKFADSDEQTRAMTEMNGQYCSSRAMRLGPASNKKNTGGPQPSSAIYQNTQGTDSDSDPNNTTVFVGGLDPSVTDELLKQTFSPYGELLYVKIPVGKRCGFVQYSNRASAEEAIRVLNGSQLGGQSIRLSWGRNPANKQPQQEQSQWSGGGYYGYPQGYDPYGYARPPQDPAMYAYAAYPGYGNYQQQPPQQPPPQQ

SEQ ID NO: 239 - DNA, 1848 bp, Zea mays
ccacgcgtccgggtttctctgcctcgccggggaagcgatgcagccgctgcaccaaccgccgatgaacgggcaacacggcccgcctcctccgcagggatccggggttcccacggcttcgcagcagcaggcgccaccgccgtcgtactaccagcagcagcagcagcagcagcaggggccaccgcctcagtactaccagcagggtcccccacagccgtgggcgcagcagcaacagtacgctccaccgccgccgcagtacccgcctcagatgcagcagtacgctccaccaccgcagcagtacgcccctccgccgcagcagcagtacgccgctccgccgcagcagcagtacgccgctccgccgccgcagtacgcgcctccgccgccgcagtacgcgcctccgccgcagcagtacgcgcagccgccgcagtacgcgcagccaccgcagtatgggacaacgccgggaagcggtgaggtcaggaccctgtggattggagatcttcagtactggatggacgagaactatctccactacaacgccttcgcgcctgtggcccagcagattgcctctgtgaaaattatacggaacaagcagactgggcactcagaaggttatggttttattgagttttactctcaagccgctgcagaacatactctgatgaacttcaatgggcagatgatgccgaatattgagatggcttttaagctgaattgggcttctgctagcactggggataagcgtggagataatggttctgaccatgcaatatttgttggtgatttggcccctgatgttacggactccatgttggaagatgtgttcagagctaactatccttcagttagaggagctaaagttgttgttgataggatcactggacggcctaaaggatatgggttcgtgcattttggagatctgaatgagcaggcacgtgctatgaccgagatgaatggaatgatgttatctacaaggaaaatgaggattggggctgcagctagcaagaagaatacagatgctcagcagacatatgcaactaatggtgcataccagagttctcaaggcaattgttcagagaatgatcccaacaatacaacagtctttgtgggtgggttagattccaatgtagacgaggagtatctaaggcaaatttttactccgtacggagaaatttcctatgtgaagattcctgtaggcaagcattgtggatttgttcaatttaccagcaggtcatgtgctgaggaagccatccaaatgctgaatgggagtcagattggtggacagaaagctcggctttcatggggccgtagtactcaaaacagacaggcttctcagcatgatgccaacagccagtataatgggaacaactattatcgataccaacagccgggtaatgaaggttatagctatggtgcacccaatgcacaagacccaagcattcaaaactactatggataccctggttatggtaactatgagcagcagtcaacacaggaacagcagcagcagcagcctccaccagcacaggagcagcctccaccggcaccacagtaacaatcatcgtggtgacgattgcttgggcacttctggaatgctatcagattagagggactacagtcagagcagtgccgtgccgaatgagacgtcctgaagatatggagggcatatagtcgcatgggtgttcttgggccggtgttaatctacgatgacactcctgatgtctcttttgtttgtcattgagatcttgacggctgaagtatgcaccgttgaaattgatgtattcgtcgtcgtcggattgtttatttgctcggaaccattttttgcactttaaaaaaaaaaaaaaaaaaaaaaag

SEQ ID NO: 240 - protein, 503 aa, Zea mays
MQPLHQPPMNGQHGPPPPQGSGVPTASQQQAPPPSYYQQQQQQQQGPPPQYYQQGPPQPWAQQQQYAPPPPQYPPQMQQYAPPPQQYAPPPQQQYAAPPQQQYAAPPPQYAPPPPQYAPPPQQYAQPPQYAQPPQYGTTPGSGEVRTLWIGDLQYWMDENYLHYNAFAPVAQQIASVKIIRNKQTGHSEGYGFIEFYSQAAAEHTLMNFNGQMMPNIEMAFKLNWASASTGDKRGDNGSDHAIFVGDLAPDVTDSMLEDVFRANYPSVRGAKVVVDRITGRPKGYGFVHFGDLNEQARAMTEMNGMMLSTRKMRIGAAASKKNTDAQQTYATNGAYQSSQGNCSENDPNNTTVFVGGLDSNVDEEYLRQIFTPYGEISYVKIPVGKHCGFVQFTSRSCAEEAIQMLNGSQIGGQKARLSWGRSTQNRQASQHDANSQYNGNNYYRYQQPGNEGYSYGAPNAQDPSIQNYYGYPGYGNYEQQSTQEQQQQQPPPAQEQPPPAPQ

SEQ ID NO: 241 - DNA, 1657 bp, Zea mays
gtgctagggttaggtcgtctcggcaagtcgccatgatgcagcagcccccgccgcagcagccgcagccgggtatggcgctacctcctccccctcagaccggtggcgggcagccaccgcagtggggcgcgatcccgccgccgatgacgcagcagtacggcgcaccacctccgcagcagcctccagcgatgtggggccagcctccgtcgcaggcgcactacgggcaggcgccgccccatcagccgtattatgccgcgccgccggtgccggtgcaggcgccagccgcccccgctgcggcggacgaggtcaggacgctctggatcggggacctgcaatactggatggacgagaactacgtcttcgggtgcttttcgaacactggggaggttcaaaatgtgaagctcatccgcgacaagaattcaggacagcttcagggctatggttttgttgagtttacaagccgtgcagctgcagaacgagttcttcagacatacaatggacaaatgatgccaaatgttgacttgacatttcggctgaattgggccagtgctggtgaaaagcgcgatgatactcctgaatatactatttttgttggggatttggctgcagatgttacagattacttgttacaagagacattcagggttcattatccctctgtcaagggtgcaaaagttgtgactgataaattgacaatgcgcacaaagggttatggatttgtgaaatttggtgatcctacagagcaagctcgtgcaatgactgaaatgaatggaatgccttgttcttccaggcctatgcgtattggtcctgcagcaagtaggaaaaatacaggaggtgttgttcaagagagagtaccaaattctcaaggagctcagtctgagaatgatcctaacaataccactatatttgttggtgggcttgaccccaatgtcactgaagataccctaaaacaagttttttctccttacggtgaagtcgtccatgttaagatccctgttgggaagagatgtggttttgttcagttcgttaccagaccttctgctgaacaagcgctgctaatgctgcaaggggccttgattggtgcacagaatgttcgactttcatggggtagaagcctgtcgaacaagcaggctcagcctcagcaggaatccaatcaatggggtgcggctgctggtgctggtggctactatgggggctatggacaaggttatgaggcttatggcagtgggtatgcacaaccccaggatcctaacatgtatggttatggcgcttatggcggttatcccaattaccaacagcaaccagctgcacagcagcaacagcaacaacagtgatgcctgtttgctcgggtaggtcattgggttgtcgcgacggaattaattaaatattatttcaggacactctcatattgcattcttgtcaattgaggtggttttgaaaggctcctgattttgatggccccatggcacggtttcatctatttattagtatatgacatatatgcgctgtgaacaagtggcgctctactgtgattgctgtgttgagacatgctttcttagtttctttccatgtttctcggatctgttgtgttacctttattactgtgtatttgcatatctactgtgatgctatatatgcactgtgccgcctttcgttcgtt

SEQ ID NO: 242 - protein, 432 aa, Zea mays
MMQQPPPQQPQPGMALPPPPQTGGGQPPQWGAIPPPMTQQYGAPPPQQPPAMWGQPPSQAHYGQAPPHQPYYAAPPVPVQAPAAPAAADEVRTLWIGDLQYWMDENYVFGCFSNTGEVQNVKLIRDKNSGQLQGYGFVEFTSRAAAERVLQTYNGQMMPNVDLTFRLNWASAGEKRDDTPEYTIFVGDLAADVTDYLLQETFRVHYPSVKGAKVVTDKLTMRTKGYGFVKFGDPTEQARAMTEMNGMPCSSRPMRIGPAASRKNTGGVVQERVPNSQGAQSENDPNNTTIFVGGLDPNVTEDTLKQVFSPYGEVVHVKIPVGKRCGFVQFVTRPSAEQALLMLQGALIGAQNVRLSWGRSLSNKQAQPQQESNQWGAAAGAGGYYGGYGQGYEAYGSGYAQPQDPNMYGYGAYGGYPNYQQQPAAQQQQQQQ

SEQ ID NO: 243 - DNA, 1287 bp, Zea mays
gcacgaggttgtggcaattaaagttatccggaataagcagaccggacagtctgaaggatacggatttgttgagttctacagccatgctgcagctgaaagggttcttgaagggttttctggtcatattatgccaaacactgaccagccctttaggttaaactgggcatcgtttagcatgggagataggcgctcggatgttgcttcggatcattccatattcgtaggcgaccttgcttccgatgtcaatgacgccacactgctggaggttttctccagcaggtactcctctgtcaaaggtgccaaagtcgttatcgatgctaacactggtagatccaagggttatggcttcgtgagatttggagatgacagtgagaagacgcatgccatgactgagatgaatggtgtgtattgctcctctaggcccatgaggattggcccggcaactccaagaaaatcatcaggtacctctggatcaaatggctcatctgctcgaccagatggaggagatttgacaaacacaacagtatttgtgggcgggctcgacccagatgtcagtgaagaggaccttaggcaggccttctcccagtacggagaaatttcttccgtaaagattccagttgggaaacagtgcggcttcgtgcagtttgctcagaggaagaacgcggaagacgcgttgcaagggttgaacggcagcactattggcaaacaggccgtgcgtctctcatggggtcgcaacccagcaaacaagcagtttaggggcgacaatggcaacatgcagtggaagaacgggggcgtgtactacgcggcgcccccgttctacaacggcggctacggctaccctgcggcggccccgttccctgatccaggcatgtacgctgctccagcctacggcgcctacccgttctatggcaaccagcagcaagtgagctgacctggactactgcgccggcctcgcttggaaagctggggcctggcctggcctggcctggagcggctgttaggtgtagctcttggtagaagaagatgaagtagacgacgacggtttcttaggtgagctagatatatataccttgactagtctcgtatagtgcgttttgttacacgtgctagctagggtctagcgccacccaccgagtgtccgacacacctattgactggccacgtacggtatgtcgaaatcaacgacaaaaggaattttcgatgacctggagctgcatgctgccttgaagcagcagaacaataaagctaatggaatcctttgcccctgcaaaaaaaaaaaaaaaaaaa

SEQ ID NO: 244 - protein, 307 aa, Zea mays
VVAIKVIRNKQTGQSEGYGFVEFYSHAAAERVLEGFSGHIMPNTDQPFRLNWASFSMGDRRSDVASDHSIFVGDLASDVNDATLLEVFSSRYSSVKGAKVVIDANTGRSKGYGFVRFGDDSEKTHAMTEMNGVYCSSRPMRIGPATPRKSSGTSGSNGSSARPDGGDLTNTTVFVGGLDPDVSEEDLRQAFSQYGEISSVKIPVGKQCGFVQFAQRKNAEDALQGLNGSTIGKQAVRLSWGRNPANKQFRGDNGNMQWKNGGVYYAAPPFYNGGYGYPAAAPFPDPGMYAAPAYGAYPFYGNQQQVS

SEQ ID NO: 245 - DNA, 1443 bp, Zea mays
gcacgaggtggagtcggagctcaactcatcaatagggtttgatcagcgctccgctcgtgctagccacccagcccccccgcgcccacttgcgacggcgatggcttcgccgtactcgctcagctgggccgacgcgccgccctaccactaccacgggagaccccagccagcgcccgactcacccgcatcctccgacggggccgggccccgctcgctctggatcggcggcctgctgccatggatggacgaggactacctctacggctgcttcaccacctcgcgcgagcttctttcccttgtcatcaaacggaacaagcagactggccaatcagagggctttggcttcctcaaattttctgaccataccgccgctgctcatattctcaagtcttacaatggtcagaagatgcctaacgctgttcaagatttcaagctcaactgggccacccaacaacctgctcccaagaaacttcctgatccagatttcaagctcgacctggccacacagcaggagaggcatgccgccgtcgattcctcatctgatcattccatattcgttggggacttggcctacaatgttacaggatacatgctacaccatgtgttcaaggcccgctacccatcagtgaagagcgcaaaaatcatctttgacaagttcactggcctctcaaaatgctatggatttgttcagtttggagatgtcgatgagcagatacaagcactgacagaaatgaatggagcctactgttctaccaggcctatgcggattggacctgttcccaagaagaaaaattctttccgcagcaaacagtggactgagtcttatcacgatgcaaacaattcaaggctatttgttgggcaacttgaccaaagtgtgacttctgaagatctgatgcaagcctttagtccatatggggagcttgttgatgtgaaggcattaccagggaagggctgtgggtttgtcacgtactctaacagggcatcagcagaggaagccattagaatgctgaatggaagtcagctgggaggtaaagccataaaactttcgtggggttacccttctgctgacaagcaggctcaaaggaacagcggcggcgggttcggacgcgactgcttcgtttggtctcctcagtatccctacgcttacgctcagacatgccaaccgggatatggatattaattaccgatagcaagctgcccacagtgcagtgagatcgtgtgaagaaagatgtcagtcacaaggaacagctgctagggtgtagagggatttttggtccatgttttttttctttttggaaattggttcctcctatggttgcataccgtgaagcatcggcatctggatccatacatgagaatgcaaacaacgattgaatgtacatttacacacatactgctactactatattaattactgtaccttgaaaaaaaaaaaaaaaaaaaaaa

SEQ ID NO: 246 - protein, 389 aa, Zea mays
VESELNSSIGFDQRSARASHPAPPRPLATAMASPYSLSWADAPPYHYHGRPQPAPDSPASSDGAGPRSLWIGGLLPWMDEDYLYGCFTTSRELLSLVIKRNKQTGQSEGFGFLKFSDHTAAAHILKSYNGQKMPNAVQDFKLNWATQQPAPKKLPDPDFKLDLATQQERHAAVDSSSDHSIFVGDLAYNVTGYMLHHVFKARYPSVKSAKIIFDKFTGLSKCYGFVQFGDVDEQIQALTEMNGAYCSTRPMRIGPVPKKKNSFRSKQWTESYHDANNSRLFVGQLDQSVTSEDLMQAFSPYGELVDVKALPGKGCGFVTYSNRASAEEAIRMLNGSQLGGKAIKLSWGYPSADKQAQRNSGGGFGRDCFVWSPQYPYAYAQTCQPGYGY

SEQ ID NO: 247 - DNA, 1799 bp, Zea mays
gcacgagcctcttcttccctccactcgcctccaaatcttctctctcctttcctcctctcgtctcaccgcatcacctctccctccggcgcgcgcgtccgggtacagcgctagagtcactcaccaccatgcaggcggcggcggcggcgaatggcgcgggcgacgtgcagaagcctcagcagcaaccgctggtggcgggggcgccgcccccaccgccgccggcggccgtggtgccgccccattgggtcgccatgccgttcgcaccgcctcccggggccgcggccatggtgatgcagccgcaccatatggcgcctccgccgccgcagttcgcgccgactcacttcgtgccgttccacgccgtcgcgccgccgcgggcacagtcggtgccagcagcggtcgcactgggttccccggcgccgcatcagcccgggcaggaggagaacaagagcgtctgggtcggcgacctccattactggatggacgagaactacctacacagctgcttcggctacaccggcgaggttgtggcgatcaaagttatccgcaacaagcagactgggcagtccgaaggatacgggttcgtcgagttctacagccacgctgcggctgaaaaagttctcgaagggttttctggccatatcatgccgaacaccgaccagcctttcaggctaaactgggcatcgtttagcatgggagacaggcgctcggattctgcctcggaccattccatattcgtaggcgaccttgcctctgacgtcaatgacgccacgctgctggaggccttctccagcaggtactcctctgtcaaaggtgccaaggttgttatcgatgctaacactggtagatccaagggctatggcttcgtgaggtttggagatgacagcgagaagacacaggccatgactgagatgaacggcgtgtattgctcgtctaggcccatgagaattggcccggcaactccgaggaaatcatcaggtacttctggatcgaatggttcagctgctcgatcagacggaggagatttgacaaacacaacggtatttgtgggtgggctcgacccaaatgttagcgaagaggaccttaggcaaaccttctcccagtacggagagatttcttctgtaaagattccaattgggaaacagtgcggcttcgtgcagtttgctcagaggaagaacgcagaggacgcattgcaaggattaaatggcagcactattggcaaacaaaacgtgcgtctttcatggggccgcaacccagcaaacaagcagttcagaggcgacaacggcaaccagtggaacaacgggggcatgtactacgcggcgcccccgttctacaacggctacggttaccctgcggcggccccgttccctgatccaggcatgtacgctgctccagcctacggtgcctatccgttctatggcaatcagcagcaagtgagctgacctggactaccgcgacacgcacgcctcgctcggagctggagactggaggtgttaggcgcttaggtgtagctctcggtagaagaagaagaggaagaaggtagacgacgacggtttcttaggtgagctagataccgtgactagtctcgtatagtgcgatttgttatacgtgctatggtctagcgccgccgacgactgagagtccgagtgtccgacacacctattgactggccacggcatgtcgaattgaacgacaaaaagaatttctgatgtcctggagctgcatgcatgctaccttgaagcagaacaataagctaatggaatcctttggcctctgctaaaaaaaaaaaaaaaaaaaaaaaaaaa

SEQ ID NO: 248 - protein, 436 aa, Zea mays
MQAAAAANGAGDVQKPQQQPLVAGAPPPPPPAAVVPPHWVAMPFAPPPGAAAMVMQPHHMAPPPPQFAPTHFVPFHAVAPPRAQSVPAAVALGSPAPHQPGQEENKSVWVGDLHYWMDENYLHSCFGYTGEVVAIKVIRNKQTGQSEGYGFVEFYSHAAAEKVLEGFSGHIMPNTDQPFRLNWASFSMGDRRSDSASDHSIFVGDLASDVNDATLLEAFSSRYSSVKGAKVVIDANTGRSKGYGFVRFGDDSEKTQAMTEMNGVYCSSRPMRIGPATPRKSSGTSGSNGSAARSDGGDLTNTTVFVGGLDPNVSEEDLRQTFSQYGEISSVKIPIGKQCGFVQFAQRKNAEDALQGLNGSTIGKQNVRLSWGRNPANKQFRGDNGNQWNNGGMYYAAPPFYNGYGYPAAAPFPDPGMYAAPAYGAYPFYGNQQQVS

SEQ ID NO: 249 - DNA, 1806 bp, Zea mays
gcacgagccgcacggcccacggcccacggcaagtctcccgcgaagtcgcaagtctcccgcacgaaccacgacaaatgtcaaccccgattcctcgccgtcgctcatctcctctctcccatctctgctagggttaggtcgtctcggcaagtcgccatgatgcagcagcccccgcagccgcagccgggtatggcgctacctcctccccctcagaccggtggcgggcagccaccgcagtggggcgcgatcccgccgccgatgacgcagcagtacggcgcaccacctccgcagcagcctccagcgatgtggggccagcctccgtcgcaggcgcactacgggcaggcgccgccccctcagccgtattatgccgcgccgccggtgccggccgcccccgctgcggcggacgaggtcaggacgctctggatcggggacctgcagtactggatggacgataactatgtcttcgggtgcttttcgaacaccggcgaggttcaaaatgtgaagctcatccgcgacaagaattcaggacagcttcagggctatggttttgttgaatttacaagccgtgcagctgcagagcgagttcttcagacatataatggacaaatgatgccaaatgttgacttgacatttcggctgaactgggccagtgctggtgaaaagcgtgatgatactcctgactatactattttcgttggtgatttggctgcagatgttacagattacttgttacaagagacattcagggttcattatccctcggtgaagggtgcaaaagttgtgactgataaattgacaatgcgtaccaagggttatggatttgtgaaatttggcgatcctacagagcaagctcgtgcaatgactgaaatgaatggaatgccttgttcttccaggcctatgcgtattggtcctgcagcaagtagaaaaaatgcaggtggtgttgttcaagagagagtaccaaattctcaaggagctcagtctgagaatgatcctaacaataccactatatttgttggtgggcttgaccccaatgtcactgaagatgtcctaaaacaagcattttctccttatggcgaagtcatccatgttaagatccctgttgggaagagatgtggttttgttcagtttgttaccagaccttctgctgagcaggcgctgctaatgttgcaaggggccttgattggtgcacagaatgttcggctttcgtggggtagaagcctgtcgaacaagcagactcagcctcagcaggaatccatgcaatggggtgcgggtgcgcctgctggtgttggtgattactatggtggctatggacaaggttatgaggcttatggcagtgggtatgcacaaccccaggaccctaacatgtatggttatggcgcttatgttggttatcccaattaccaacagcaaccagctgcacagcagccacagcaacaacagtgaggcctctttgctcgggtaggtcattgggttgtctgagatgggatcaattagtattatttctaggcattcatatattgatttcttgaaaatagaggtggtttcgaaaatctcctgattttgatggccccatggcatgttttcttcgagttatatcatatatatatgcactatgttatgtctatgaacaagtggtgctcaactgtgattgctatgttgaggcatgcttcgtagtttccttccagacttgtcttatatattgttctctcttttactctgtattgttatctctattagtgtgtattgcatatctactgcgatgctatatatgcgctgtgccgcctttcgttaaaaaaaaaaaaaaaaaaa

SEQ ID NO: 250 - protein, 428 aa, Zea mays
MMQQPPQPQPGMALPPPPQTGGGQPPQWGAIPPPMTQQYGAPPPQQPPAMWGQPPSQAHYGQAPPPQPYYAAPPVPAAPAAADEVRTLWIGDLQYWMDDNYVFGCFSNTGEVQNVKLIRDKNSGQLQGYGFVEFTSRAAAERVLQTYNGQMMPNVDLTFRLNWASAGEKRDDTPDYTIFVGDLAADVTDYLLQETFRVHYPSVKGAKVVTDKLTMRTKGYGFVKFGDPTEQARAMTEMNGMPCSSRPMRIGPAASRKNAGGVVQERVPNSQGAQSENDPNNTTIFVGGLDPNVTEDVLKQAFSPYGEVIHVKIPVGKRCGFVQFVTRPSAEQALLMLQGALIGAQNVRLSWGRSLSNKQTQPQQESMQWGAGAPAGVGDYYGGYGQGYEAYGSGYAQPQDPNMYGYGAYVGYPNYQQQPAAQQPQQQQ

SEQ ID NO: 251 - DNA, 1689 bp, Zea mays
gcacgagctccatccgaccacccccgcgagcttcgacagttcgacacacgcggccgccccttcccggctccagccacaccccccggaggcggcgatgcagatggcagcggcagttgcccccaccgacgccccggcctcggcgtctgcggcggcggcgccctcccgcccccacgcgcacgccgcggcagcggtggcggccgcgtcgcctcacccgcacgcactgcatccgcatcaccatatgccgcaaccgcggtgggtggtcatcccataccctcctccacaccatcccatggtggccgcgccgccgccaccttctctgcagtttgtgaagcattttacgccgccgtcctcggtaacaccgccgccgccgactggatccggcgggaacgggggcgaggataaccggaccatctgggtgggcgacctgcagtactggatggacgaaaactatcttcacagctgcttcggctctagcggcgaggtggtgaatattaaagtcattcgcaatagacactcgggagtttctgagggttatggttttatagagttttatactcacgtttcagcagagaaggcactgcagaatttttctggtcacgtaatgcctaatactgaccgggcttttaagttaaactgggcatcatatagtatgggagaaaaacgctcggaaatttcgtctgatcactcgatatttgttggcgatttggctgttgatgttactgatgcgatgttgctggaacttttttctaacaaataccgatcggtgaaaggagctaaagttattattgatgcaaacacaggccgttctagaggctacggctttgttaggtttggagatgataatgacaaaattcatgcaatgactgaaatgaatggtgtttactgttccacaagaccaattcgtgtaggaccagcgactcctagaagatctcaaggtgattctggcacttctccaccaaggcaatctcatgttgactctactaacaggacggtatatgttggtgggcttgaccccaatgttagcgaagatgaactgaggaaagcatttgcaaaatatggtgatcttgcctctgtcaaaattccttttgggaaacaatgtgggtttgttcaatttgtaaacagagttgatgctgaagaagcactgcatgggttgaatggatcaactattgggaagcaggcagttcgactttcctggggccgcagccctgcaagtaaacagtctaggggtgattctggccaccggcgcaatggcaactgcaacggcatgtactacgggacaccattctacggtggatatggctacgcctccccgattccgcacccaaacatgtacgccgcggcctacgaagcctacccgtactatgggaaccagcagctagtgagctgatgtagtgatgtggcgagatgctctctgctcagttttcctcccttggaggaaacgagtttttggtcccagtaaaagcatagtagctatgatgagatatatgataggtggccataaaaatgggcgcgagagacgagacaggcatatgatggtaacgctacctgcagatttgtgctgctagtagaacctaaaagagcttgtagtagacaaataaaaccttttcttttgtcttggaaattttgactcgctaataaaaagtgaagctatctgttgtaaaaaaaaaaaaaaaaaaaaaactcgctagt

SEQ ID NO: 252 - protein, 430 aa, Zea mays
MQMAAAVAPTDAPASASAAAAPSRPHAHAAAAVAAASPHPHALHPHHHMPQPRWVVIPYPPPHHPMVAAPPPPSLQFVKHFTPPSSVTPPPPTGSGGNGGEDNRTIWVGDLQYWMDENYLHSCFGSSGEVVNIKVIRNRHSGVSEGYGFIEFYTHVSAEKALQNFSGHVMPNTDRAFKLNWASYSMGEKRSEISSDHSIFVGDLAVDVTDAMLLELFSNKYRSVKGAKVIIDANTGRSRGYGFVRFGDDNDKIHAMTEMNGVYCSTRPIRVGPATPRRSQGDSGTSPPRQSHVDSTNRTVYVGGLDPNVSEDELRKAFAKYGDLASVKIPFGKQCGFVQFVNRVDAEEALHGLNGSTIGKQAVRLSWGRSPASKQSRGDSGHRRNGNCNGMYYGTPFYGGYGYASPIPHPNMYAAAYEAYPYYGNQQLVS

SEQ ID NO: 253 - DNA, 1620 bp, Zea mays
ccacgcgtccgcacccctccacacgaccctcctcggcggcggcggcggcgatgcagatggcggcgaccaccaccgagtcccaggcggccgtgccgcctcaacaccctcacgcccacccccacgcgcccccgcagcatgctcacccgcaccaccacatgccgcagccacggtgggtcgtcatcccgtacccgccgccgccgcccatggtggccgcgccaccaccgccgccgcagtttgccaagcacttcgctgctgggccgcccccgccgccccaagctggtgctgggcgccgcacgccgaccccgccctcgtctggatccggcgggaacgggtgcgaagaaaataaaaccatttgggtcggtgacctccagtactggatggatgaaaactacctacataactgcttcgggcccagcggcgaggtggttacaataaaagttatccgcaataggcaaacaggacagtcagaggggtatggatttgttgagttcttttctcatgcatcagcagagaaagctcttcagaattttactggtcatgtgatgccaaacactgaccggccatttaaattgaactgggcatcgtatagcatgggtgaaaagcgatctgaagtggcttctgatcactcgatatttgttggcgatctagctgctgatgtcactgatgaaatgctgctggagcttttctccagcaagtaccgctcggtgaaaggagctaaagttattattgatgcaaacacaggccgttccaggggctatggatttgtcaggtttggagacgacaacgacaaatctcatgccatgtctgaaatgaatggtgtatattgctctacgaggccaattcgtataggacctgcgactcccagaagatcttcaggtgattctggctcctcgactcctggtcattcagatggtgattcttctaacagaacggtatatgttggtgggcttgaccccaatgtcagtgaagatgaactgagaaaagcctttgccaaatatgatcttgcctctgtgaaaattcctctaggaaagcaatgtggctttgttcaatttgttagcagaactgatgctgaagaagcactacaaggattaaatggatcactcattggaaagcaggcagttcgcctttcatgggtccgcagcccatcgcataagcagtctaggggtgactccgtcaacaggaggaacaacatgtactatggcacaccattctacggcggatatggctatgcctccccggtgccacacccaaacatgtacgctgcagcgtatggcacgtacccgctatatggcaaccagcagctagtgagctagagagctcccctccgacgtgtcccctctgacgggaaacaaaggttttggtccggtgagcatagtagcgtcaggtgagaaggtgcctttataaggctgtcctaagaagtgggcgagatatgttgttgcatcgttatcgttatggtgcctgtaactgttgtgtgtgccgtgtgcgtccggaagaattggatggaatggaactcgtggcttgttgtagtacatcagagagtcatgttattctttcaagaaattttgacttggtaataaattaaactattgtttgtgcgtcaaaaaaaaaaaaaaaaaaaag

SEQ ID NO: 254 - protein, 420 aa, Zea mays
MQMAATTTESQAAVPPQHPHAHPHAPPQHAHPHHHMPQPRWVVIPYPPPPPMVAAPPPPPQFAKHFAAGPPPPPQAGAGRRTPTPPSSGSGGNGCEENKTIWVGDLQYWMDENYLHNCFGPSGEVVTIKVIRNRQTGQSEGYGFVEFFSHASAEKALQNFTGHVMPNTDRPFKLNWASYSMGEKRSEVASDHSIFVGDLAADVTDEMLLELFSSKYRSVKGAKVIIDANTGRSRGYGFVRFGDDNDKSHAMSEMNGVYCSTRPIRIGPATPRRSSGDSGSSTPGHSDGDSSNRTVYVGGLDPNVSEDELRKAFAKYDLASVKIPLGKQCGFVQFVSRTDAEEALQGLNGSLIGKQAVRLSWVRSPSHKQSRGDSVNRRNNMYYGTPFYGGYGYASPVPHPNMYAAAYGTYPLYGNQQLVS

SEQ ID NO: 255 - DNA, 1184 bp, Oryza sativa
gcacgaggttctacagtcatgctgctgctgagaaagtacttgaaggatttgctggtcatataatgccaaacactgaccaaccttttaggataaattgggcatcatttagcatgggggacagacgttcagatattgcttcagatcattccatatttgtaggcgaccttgcttctgatgtcaatgataccacattactagagactttctccaaaaggtactcctctgtcaaaggtgcgaaagttgttattgatgctaatactggtagatcaaagggctatggttttgtgagatttggagatgataacgagaagacacatgccatgactgagatgaatggtgtgtattgctctaccaggccaatgagaattggccctgcaactcccagaaaaacctcaggtacttctggacctactggttcagctgctcgatcagatggagatttgacaaacacaactgtatttgtcggtgggcttgatccaaatgttagtgaagatgaccttaggcaaacattttcgcaatacggtgaaatttcatcggtaaagatcccagttgggaaacagtgcggctttgtgcagtttgttcagaggaagaatgcggaagatgcattgcaaggactgaacggaagcaccattgggaaacagaccgtgcgtctttcgtggggacgcaatccagcaaacaagcagttgaggagtgacaatggcagtcagtggaacaacgggatgtactacgcagcctcgccgttttacagtggatacggctaccctgcaccgttccctgctgatccgggcatgtacgctgctgcttatggcgcctacccgttctacggaaaccaacaacaagtgagctaagaggtcacttgtgcttcacctcaaactggagctaggcacgcaagcattagcagtagctcttgctagaagaaaaaaagaacaaggtagacgacggtttcctaggtcagctagatgcagtcactggttatgtaaagtacattactacacgaactagctagcgccactaagccgccctattgactggccatggtctgctgaactcttcttccagaaaagaagttttgacctggagctgcaccttattgaagtagaacaataaacttttccaaaaaaaaaaaaaaaaaaaaaaaaaaaaaaaaaaaaaaaaaaaaaaaaaaaaaaaaaaaaaaaaaaaaa

SEQ ID NO: 256 - protein, 279 aa, Oryza sativa
FYSHAAAEKVLEGFAGHIMPNTDQPFRINWASFSMGDRRSDIASDHSIFVGDLASDVNDTTLLETFSKRYSSVKGAKVVIDANTGRSKGYGFVRFGDDNEKTHAMTEMNGVYCSTRPMRIGPATPRKTSGTSGPTGSAARSDGDLTNTTVFVGGLDPNVSEDDLRQTFSQYGEISSVKIPVGKQCGFVQFVQRKNAEDALQGLNGSTIGKQTVRLSWGRNPANKQLRSDNGSQWNNGMYYAASPFYSGYGYPAPFPADPGMYAAAYGAYPFYGNQQQVS

SEQ ID NO: 257 - DNA, 1644 bp, Oryza sativa
gcacgagtggtaccttctctagggttttgactcctaaaccgccgcccccgtcctcccgcgccgccatgatgcagccgccgccgccgccgcagtgggcaatggggccgccgcctcctccgcagtacttccaggctggccctccgccgccgccgccacagtacttccagggggcgcatccacccgctgccatgtggggccagcccccgccgccgcaggctgcccctccgccggcgccggctggtggcgcagcaggggacgaggtgaggaccctgtggatcggcgacctccagttctggatggaagagaactacctgtacaactgcttctcccaggccggcgagcttatctcagcaaagataattcggaacaagcaaactgggcaacctgagggttatggtttcattgaatttggcagccatgctatagccgaacaagttctgcaaggctataatggtcaaatgatgcctaatggtaatcaggttttcaaattaaattgggcgacaagtggtgctggcgagaagcgtggagatgatggctcagattatactatatttgttggggatctcgcctcggatgttacagatttaattcttcaagatacattcaaggcccattaccaatcagttaagggtgcaaaagttgtctttgacagaagtactggtcgttcaaaaggctatggatttgttaagtttggagatttggatgaacagacacgtgcaatgactgaaatgaatggacaatattgttctagcaggcctatgcgtattggaccagcatccaacaagaaaaatataggtggccaacaacaaccaagtgctacataccagaatacacaaggaacagattctgatagcgatccaaacaatactactgtatttgttggtggtcttgatccaagtgtgactgatgaggttctgaaacaagccttcagtccatatggagaacttgtctacgtcaaaatacctgtaggaaagcgttgtggatttgttcaatattccaatagggcttcagctgaggaggccataaggatgctaaatggaagccaattaggaggtcagagcataaggctttcatggggtcgtagccctggaaacaagcagcctcagcaagaccagaaccaatggaatgctggctattatggatatcccccccaaggatatgatccatatggttatgttcggccgcctcaagatcctgccatgtacgcttatgcagcatatcctggatacgggaattatcaacaaccagcgccacagcagccccctcaacagtaagaacaagtgttggtcaagtgccctatcacaacatatgatgaaatagttttggcaactttggtgtaattggcatgaaaattttttgaactgttgcttgtgctatctttgttgaacgtcgtgtgcacgcccagcctatgttgtaacatgacattttactgaggcctaggtgacactagaatgacagcttttagggagggagtattggagtgaacatttttcgcttgctcaaaaagttttgtcgccatgggtaccattagaagaggagttgagcaagaaataataagtttgtaacattagacatcggcgtacattttaatcgggcactttggtattattgcaaaaaaaaaaaaaaaaaaaaaaaaaaaaaaaa

SEQ ID NO: 258 - protein, 402 aa, Oryza sativa
MMQPPPPPQWAMGPPPPPQYFQAGPPPPPPQYFQGAHPPAAMWGQPPPPQAAPPPAPAGGAAGDEVRTLWIGDLQFWMEENYLYNCFSQAGELISAKIIRNKQTGQPEGYGFIEFGSHAIAEQVLQGYNGQMMPNGNQVFKLNWATSGAGEKRGDDGSDYTIFVGDLASDVTDLILQDTFKAHYQSVKGAKVVFDRSTGRSKGYGFVKFGDLDEQTRAMTEMNGQYCSSRPMRIGPASNKKNIGGQQQPSATYQNTQGTDSDSDPNNTTVFVGGLDPSVTDEVLKQAFSPYGELVYVKIPVGKRCGFVQYSNRASAEEAIRMLNGSQLGGQSIRLSWGRSPGNKQPQQDQNQWNAGYYGYPPQGYDPYGYVRPPQDPAMYAYAAYPGYGNYQQPAPQQPPQQ

SEQ ID NO: 259 - DNA, 1494 bp, Oryza sativa
  unsure (1429): n is a, c, g or t
gcacgagtgtatcctcctctcgcgaccaccaaccagcggcggcggccgggggtggatccggcggagggaacggggacgagaaccggacgatttgggtcggggatctccagtactggatggacgagggctacctgcacaactgctttggccccagcggcgaggtggtcacaattaaagttattcgtaatagacattctggagtttctgagggttatggttttgttgagttcttttctcatgcatcagcagagaaagcactccagaatttttctggtcatgtaatgcctaataccgaccgagcttttaagttaaactgggcatcatatagcatgggagaaaagcgcgccgaacttgcttctgatcactcaatatttgttggtgatctggctgttgatgttacggatgaaatgttgatggatctttttgccaaaaaataccgatctgtgaaaggagctaaagttattattgatgcaaacaccggacgttctaggggctacggctttgttaggtttggagatgataacgacaaaactcatgcgatgactgaaatgaatggtgcatattgctctacccggccaattcgtataggacctgcaacacctagaagatcttcaggtgattctggctcctcgccaccaaggcagtcagatagtgactcaactaacaggacgatatatgttggcgggcttgatcccaacgctactgaagatgaactaaggaaagcatttgctaagtatggtgatcttgcctctgttaaaattcctgttggcaaacagtgtggttttgttcaatttgtcaacagacctgatgcagaagaagcactgcaagggttgaatggatcaacaattggaaagcaggcagtgcgtctttcctggggccgcagtccagcaagcaaacagtctaggggtgattccggccaccggcgcaatggcatgtactacggtacacctttctacggtggatatggctatgcgtcgccacttccacacccaaacatgtatgcagcagcatatggagcctacccttactacggtaaccagcagcttgtgagttgatgagaggcttctctcttgtttcctccaatggaaaacgaggttttggtccagtaagcatagtagcgtgtgatgagatatttatagatggccataaagaagttggtgagacagcaggtattacctgaaatggtacctgcagatttgtgtcagtgagtaccgagtagaacctaaaaagcttgtagacaaaataagagttgttcttattctttcaagaaattttgactcgctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaaaaaaaaaggggggaaanggccgcaaaaaaaaaaaaaaaaaaaaaaacccccggggggggggggggaacaatttccccccaag

SEQ ID NO: 260 - protein, 350 aa, Oryza sativa
TSVSSSRDHQPAAAAGGGSGGGNGDENRTIWVGDLQYWMDEGYLHNCFGPSGEVVTIKVIRNRHSGVSEGYGFVEFFSHASAEKALQNFSGHVMPNTDRAFKLNWASYSMGEKRAELASDHSIFVGDLAVDVTDEMLMDLFAKKYRSVKGAKVIIDANTGRSRGYGFVRFGDDNDKTHAMTEMNGAYCSTRPIRIGPATPRRSSGDSGSSPPRQSDSDSTNRTIYVGGLDPNATEDELRKAFAKYGDLASVKIPVGKQCGFVQFVNRPDAEEALQGLNGSTIGKQAVRLSWGRSPASKQSRGDSGHRRNGMYYGTPFYGGYGYASPLPHPNMYAAAYGAYPYYGNQQLVS

SEQ ID NO: 261 - DNA, 1423 bp, Oryza sativa
ccgctccgggaggcgacgagatcaggtcgctgtggatcggggatctccagtactggatggatgagagctacctctccaacgcttttgcccccatgggacagcaggttacctctgtgaaagtcatccgcaacaagcagagtgggcactctgagggttatggttttattgaatttcagtctcacgctgctgcagaatatgctctggctaactttaatgggaggatgatgcttaatgttgaccaacttttcaagctaaactgggcttctagtggtgctggtgaaaggcgtgctgctgatgatggtcctgagcacacaatatttgttggtgatttagcttctgatgttacagactccatgttggaagaagcattcaaaaccagttatccttcagttagaggagccaaagttgtttttgacaaagtcactgggcgatccaagggatatggttttgtacgttttggagatgaaaatgagcaaacacgtgctatgactgagatgaatggagcgaccttgtctacaaggcaaatgaggcttgggccggcagctaacaagaagaatatgggtacccagcagacatattcaacaaatggttaccagagctcccaaggaaacagtttggagaatgatcccaataatacaacaatctttgtgggcgggttagattccaatgtaaatgaggaccatctaaagcaagtatttactccatatggggaaattggttatgtgaagattcctctaggcaagcgttgtggatttgtccaatttactagcaggtcatctgctgaagaagccatccgtgtgctgaatgggtctcagattggtgggcagcaagttcggctttcatggggccgtactcctcagaacaagcaggctccccagcaggatgccaaccagtggaatggcaactactatggataccaacagggctatgattcttcttactatggtgcacccaatgcacaggatcctagtgcgcaaaactactatggatattctggctatggcaattacgaacagcagcaggagcccccacagcagcagcagcaacccccacaacagcccccacagcagtgaccatggcgacgtgcaactttcagatctcgcagttggattatcagggtgtacattttgcgtgaactcgagctggcgcttccttaagttatttgtagatgtctttgtgtggatgaggtcgtgttctagctccgctaccacctgtcgttagacgactgatcgaacccttttgacagtagccagtgtttcgttttttgggcctccctgggtgtgatgatcatcaaatctgatgctctgagagttactgaggcgactaatgttatttatggatggtttgtttgggcttttgcatggaaatgaaaccatcacccccctgtgaggctgtgattcccgtcaaaaaaaaaaaaaaaaaa

SEQ ID NO: 262 - protein, 356 aa, Oryza sativa
APGGDEIRSLWIGDLQYWMDESYLSNAFAPMGQQVTSVKVIRNKQSGHSEGYGFIEFQSHAAAEYALANFNGRMMLNVDQLFKLNWASSGAGERRAADDGPEHTIFVGDLASDVTDSMLEEAFKTSYPSVRGAKVVFDKVTGRSKGYGFVRFGDENEQTRAMTEMNGATLSTRQMRLGPAANKKNMGTQQTYSTNGYQSSQGNSLENDPNNTTIFVGGLDSNVNEDHLKQVFTPYGEIGYVKIPLGKRCGFVQFTSRSSAEEAIRVLNGSQIGGQQVRLSWGRTPQNKQAPQQDANQWNGNYYGYQQGYDSSYYGAPNAQDPSAQNYYGYSGYGNYEQQQEPPQQQQQPPQQPPQQ

SEQ ID NO: 263 - DNA, 1604 bp, Oryza sativa
ccgaccttctcaccgccgcgcctccgcctccgcctccgcctcaagccgccgcccgccgccgccaggagcggcctctccatggcggcagcgccgtaccaccagccgaccagcctggaggaggtcaggacgctctggatcggcgacctccagtactgggccgacgagaactacctctacaactgcttcgcccacaccggcgagttacaatctgtaaaaataatacgtaacaagctaacaagccttccagaaggttatggattcatagagttcatttctcatgaagttgccgagaaagttctacagacttacaatggcacacaaatgcctggaactgagcatacattcagattgaactgggcctctttcagctctggtgagaggcgtcctgatgcaggacctgatcattcgatttttgtgggagacttggcgcctgatgtcacagattacttgctacaggagacattccgtgtgagctatccttctgtcaaaggggctaaggttgtcacggatccaaatactgggaggtccaaagggtatggatttgtaaagtttgcagatgaaaatgaaaagaatcgtgcaatgacagaaatgaatggtatgtattgctcaacaagacctatgcggataagtgctgcaatacctaaaaaaaccactggatctcagcttcagtatggagctgctaaagccatgtatccagcagcaggttatgcagttccgcaagtccaaccagttctaccagatagtgatccgacaaacaccactatatttataggtaacttggatcagaatgtgacagaagatgaactcaggcagatctgtgtccaatttggggagcttatatatgtaaaaattccagccaataaagcttgtggatttgtacaatatgcatctcgggcatcagctgaagaggcagtacaacgtcttcatggcacaacgatcggccaacaagtagtcaggctttcatggggcaggagtcctgcgagcaagcaggatcaatcagctgtctggagtcaacaagctgatcctaatcaatgggcaagtgcttattatggctatggatatgatgcatatggatatgcccaggacccatcatatgcatacaattcttatgcaggatatacccagtacccccagcaggttgagggagcgaccgatatggcatcagcagctggaagccatgccccaggaatggaaaaggaggaggtgtatgatccaatgaacttacctgatgttgacaagttgaatgcgtcgtacatcgctgttcatggtagagccatgcttgggcgatccctgtggttgagaacttcatcattgcctcagtcagcttgagcgcctatttatcactcctcgttgccttttttactgaagactgcaatgccagtagagccagttggtagtttgcaaaaacggagaaactgtgacaggctgactgacagcttaatgtatgttgatttgtcatcacatgtatgattagggaaccccttttgctgagcctcttctaagtgaacagattactgccaatgatgcggctactttatgatgccaagttactggatgaaaatcatcagaaaaaaaaattctgtctaaaaaaaaaaaaaaaaaaa

SEQ ID NO: 264 - protein, 416 aa, Oryza sativa
MAAAPYHQPTSLEEVRTLWIGDLQYWADENYLYNCFAHTGELQSVKIIRNKLTSLPEGYGFIEFISHEVAEKVLQTYNGTQMPGTEHTFRLNWASFSSGERRPDAGPDHSIFVGDLAPDVTDYLLQETFRVSYPSVKGAKVVTDPNTGRSKGYGFVKFADENEKNRAMTEMNGMYCSTRPMRISAAIPKKTTGSQLQYGAAKAMYPAAGYAVPQVQPVLPDSDPTNTTIFIGNLDQNVTEDELRQICVQFGELIYVKIPANKACGFVQYASRASAEEAVQRLHGTTIGQQVVRLSWGRSPASKQDQSAVWSQQADPNQWASAYYGYGYDAYGYAQDPSYAYNSYAGYTQYPQQVEGATDMASAAGSHAPGMEKEEVYDPMNLPDVDKLNASYIAVHGRAMLGRSLWLRTSSLPQSA

SEQ ID NO: 265 - DNA, 1249 bp, Oryza sativa
gcacgagattggatggacgagaactacctccacagctgtttcggacccagcggcgaggtagtgacgataaaagttatccgcaatagacaaactggacaatccgagggatatggttttgtagagttctactctcacggatcggcagagaaggctcttcagaattttactggtcatgtgatgcctaacactgatcgacctttcaagttaaactgggcttcatatagcatgggtgaaaagcgatctgaagttgcttctgactactcaattttcgttggtgatctagctgctgatgttactgatgaaatgttgatggagctttttgctaataagtaccgctctgtgaaaggagctaaagttattattgatgcaaacacaggccgttctaggggctatgggtttgttagatttggagatgacaatgacaaatcccatgcaatgactgaaatgaatggtgcgtattgctctactaggccaattcgtattggacctgcaactcccagaaggtcttcaggtgattctggctcctcaacacctgggcattcagatggcgattctactaacagaacggtatatgttggtgggctcgatccaaatgtcagcgaagatgagctgaggaaggcatttgccaaatatggtgatgttgcctctgtaaaaattcctctagggaagcaatgtggctttgttcaattcgtcagcagaactgatgcggaagaagcactgcaaggattgaatggatcagtcattggaaagcaggcagttcgcctttcatggggccgcagcccatcacataaacagtctagggctgattctggcagccgaagaaacaatatgtactatgggacgccattctacggtggatacggttatgcctcccccgtcccgcaccctaacatgtatgctgctgcatatggagcctaccctgtctatggcagtcagcagctagtgagctagagaagagagagagagagagagcttcattccattccctccaatggaaaacaaggttttggtccggtcagcatggtagcgccagatgtgaggttatagaacgtcctaaaagcgagtgaaacaggtaaaatgaatgtatggtatctgtagtgttgtctgtgttgcaagaagtataactcaaggcttgtagacacaagtgagtcgatggtattctttcaagaaattttgacttgctaataaattaaactattgtttgtgtgtcaaaaaaacaaaaaaaaaaaaaaaaaaaaaaaaaaaaaaa

SEQ ID NO: 266 - protein, 316 aa, Oryza sativa
ARDWMDENYLHSCFGPSGEVVTIKVIRNRQTGQSEGYGFVEFYSHGSAEKALQNFTGHVMPNTDRPFKLNWASYSMGEKRSEVASDYSIFVGDLAADVTDEMLMELFANKYRSVKGAKVIIDANTGRSRGYGFVRFGDDNDKSHAMTEMNGAYCSTRPIRIGPATPRRSSGDSGSSTPGHSDGDSTNRTVYVGGLDPNVSEDELRKAFAKYGDVASVKIPLGKQCGFVQFVSRTDAEEALQGLNGSVIGKQAVRLSWGRSPSHKQSRADSGSRRNNMYYGTPFYGGYGYASPVPHPNMYAAAYGAYPVYGSQQLVS

SEQ ID NO: 267 - DNA, 1572 bp, Glycine max
gcaccagaagagacagaaagaaggacactgttcacggttagggtttgagtctcaaccactctttctttaaagcacagtctcgcattcctccttgcctctttgttctctctttttctctctccttctttctttgtttctgtgtgttcgagattgaagaagatgatgcaggctggacccggcggcatggcccaacaagcgaaccaacaatacgcacagcaacagcaacaaccctacatgatgatgccgccgcagcctcagccccctcagatgtgggccacatcggcccagcctccgtcccagtcggtggctcctccgcaacccaccagcgccgatgaggtccgtaccctctggatcggtgatttgcagtactggatggacgaaaattatctctacacctgtttggcacacaccggcgaggtggcttcagttaaagtcattcggaacaaacaaactagtcaatcggagggatatgggtttattgagtttactagtcgtgctggtgctgagagagtccttcaaacatacaatggcaccattatgccaaatggcgggcagaacttcagattgaactgggcaactcttagtgcaggtgagaggcgtcacgatgatagcccagatcacaccatatttgttggagacctggctgccgatgttacggattatcttcttcaagagacatttcgggcacgatatccctcaattaagggggccaaagttgtaattgataggctaactggacggacaaagggttatggttttgttaggtttggagatgagagtgaacaggttagagctatgactgaaatgcaaggggttctttgttcaacaaggcccatgcgaattggaccagcctctaataaaaaccctagcactcagtctcagccaaaagcatcatatcagaatcctcaaggggcacagaacgagcatgatccaaataatacaactatttttgtcggcaatttggatcctaacgtcacggatgaccatttgagacaagtttttgggcattatggagagttagttcatgtgaagattccagctggcaagcgatgtggatttgtccaatttgcggaccggagctgtgcggaagaggcactgcgggttttgaatggcacacttctaggcggacaaaatgttaggctttcatgggggcgaagtccttcaaacaaacaggctcaaccagatgcaaaccagtggaatggtagtggtggtggatactacggatatgctcaggggggctatgaaaattatggttatgcccctgctggacaggaccccaatatgtatggcagttatcctgggtatgcgaattaccaacctccccagcaacagcagcaaataggatatagctaagaagttgggcaccaattttttccgttttcttctgtaatgctatgctattgctaagatactcgttttggttgcttctcttttattgtatcgtggagaacaaacttggctgaatacattctatgcgaataggatatagctaagaagtttcttatgacattctatgcgaattttattttgtatccattaaatattgcttgctgaaaaaaaaaaaaaaaaaaa

SEQ ID NO: 268 - protein, 397 aa, Glycine max
MMQAGPGGMAQQANQQYAQQQQQPYMMMPPQPQPPQMWATSAQPPSQSVAPPQPTSADEVRTLWIGDLQYWMDENYLYTCLAHTGEVASVKVIRNKQTSQSEGYGFIEFTSRAGAERVLQTYNGTIMPNGGQNFRLNWATLSAGERRHDDSPDHTIFVGDLAADVTDYLLQETFRARYPSIKGAKVVIDRLTGRTKGYGFVRFGDESEQVRAMTEMQGVLCSTRPMRIGPASNKNPSTQSQPKASYQNPQGAQNEHDPNNTTIFVGNLDPNVTDDHLRQVFGHYGELVHVKIPAGKRCGFVQFADRSCAEEALRVLNGTLLGGQNVRLSWGRSPSNKQAQPDANQWNGSGGGYYGYAQGGYENYGYAPAGQDPNMYGSYPGYANYQPPQQQQQIGYS

SEQ ID NO: 269 - DNA, 1757 bp, Glycine max
gcaccagccctttctcagtttctctctctagaaaaaccaaaacctggctcctttttttagctctttccttatttagccttcacacactccaaactgtgaaatccatttttagcaaagtaaaaaaaagtgagccagtgtgagagagagtggtcatcagtcatcaccgttgattgattaagatgcagcaatcaaacggctctgattcgacgactacgatggagcagagcgcgccgccgcctccgaggcaatcaccggcggtggcgaggccgcagcagtgggtgccgatgcagtaccctgcggcggcggcgatggtaatgccgcaccacatgttgccgcctcagcattatgcgccgccgccgtacgtgccttaccaccaccagtacgcggcgcagccccagcaccagcaccagaacggatccggcggtgagaacaaaaccatctggatcggcgatttgcatcattggatggacgaaaactatctccatcgctgtttcgcttccaccggcgagatttcctccatcaaggttattcgcaataagcaaactggcctatcagagggttatggatttgtggagttctattcacatgctacagctgagaaagttttgcaaaattatgctggaattttgatgcccaatgctgaacaaccattccgtctgaactgggcaacatttagcacaggagacaagggttcagataatgttcctgacctttctatttttgtaggagatttagctgcagatgttacagatagtttgttgcatgaaacttttgctagtgtatatccttctgttaaagctgcaaaagttgtttttgatgccaatactggccgttcaaagggctatggtttcgtcaggtttggagatgacaatgagagaacccaggccatgactcagatgaatggtgtttactgttctagcaggccaatgcgtattggtgctgcaactcctaggaaatcatctggccatcaacagggtgggctgtcaaatggcacagccaaccaatctgaagcagattctactaacacaactatatttgttggaggactggaccctaatgtttcagatgaagatctcaggcagccattctcccagtatggtgagatagtctctgttaagatacctgttggaaagggctgtggctttgtccaatttgcaaacagaaataatgctgaagaggcattgcagaagctaaatgggacaacgattggcaagcaaacggtccgtctttcttggggtcgtaatccagcaaataagcagtttagaatggatttcggcagcccttggactggggcatattacggggcccctatgtatgatggttatgggtatgcattgccccctcgtcatgatcccagcatatatgctgctgcttatggtgcttaccccctttatggaggccaccaacaacaagtaagctgaatgaagtgcagtgcaggagtagcattcacaacaagttagacagcatcaagcttgaatgtgcaaattaagtttctctgtttgtaacttgcttgatctgttgaattcttaagacaagaatccctcctaattgtggagtggagatgaattttgatagcctgaggtagctctgtagggattcaattagtcattttgtttaggcctgtaggagtcatgactaatgaggaccttaaacttattataggaataattgtcttaagtatgtcagcgtgtgtgcttgcttgctatttatttgtttccggcagttgacattgaaaaaaaaaaaaaaaaaaaaaaaaa

SEQ ID NO: 270 - protein, 413 aa, Glycine max
MQQSNGSDSTTTMEQSAPPPPRQSPAVARPQQWVPMQYPAAAAMVMPHHMLPPQHYAPPPYVPYHHQYAAQPQHQHQNGSGGENKTIWIGDLHHWMDENYLHRCFASTGEISSIKVIRNKQTGLSEGYGFVEFYSHATAEKVLQNYAGILMPNAEQPFRLNWATFSTGDKGSDNVPDLSIFVGDLAADVTDSLLHETFASVYPSVKAAKVVFDANTGRSKGYGFVRFGDDNERTQAMTQMNGVYCSSRPMRIGAATPRKSSGHQQGGLSNGTANQSEADSTNTTIFVGGLDPNVSDEDLRQPFSQYGEIVSVKIPVGKGCGFVQFANRNNAEEALQKLNGTTIGKQTVRLSWGRNPANKQFRMDFGSPWTGAYYGAPMYDGYGYALPPRHDPSIYAAAYGAYPLYGGHQQQVS

SEQ ID NO: 271 - DNA, 1722 bp, Glycine max
tttctctcttcgcctggtcttggcatctccgcagcaccaccacccaccaccctgcttagaccaggtcctctctctctctagagagaaagagaaaaaagaaaaaaaaaaaacaactaacattaagcttttaatagtaagacatggctcaacccagttccaacggggatctgaataataaccagcagcagggtcaggttcagcaacaacagcagcagggtcagtgggcggcggcggcgcagccgcatcagtatcagcagcaatggatggctatgcagtacccggccaccgccatggccatgatgcagcaacagatgttgatgtacccgcagcattatatgccctatgctcaccctcattacccgccgccgccgccgcctcctccctcctcccaccaccaccaccaccacaaacaggccgcggcctcctccgacgagatcaggaccgtctggctcggcgacctccaccattggatggacgagaactacctccacaactgctttgctcacaccggcgaggttgtttcggccaaggtcattcggaataagcaaactggtcagtccgagggatatggattcgtggagttctattcgcgagggacggctgagaaagtcttgcagaactataatggcacgatgatgcccaatacagatcaggcattccgtctgaattgggccacattcagtgccggggaaggacgttcctccgatgctacttcggatctctctatatttgttggggacttggccattgatgttaccgatgctatgctgcaggatacttttgctggccgatattcgtctattaagggagcaaaagttgtcattgattctaatactggccgctcaaaaggctatggttttgttaggtttggtgatgaaaacgagagaacgagggcaatgaccgaaatgaatggcgtttattgttctagtaggcccattcgaataggtgttgcaactcccaagaaaacttatggcttccaacaacaatattcttctcaagctgtggtattggctgggggacactcagctaatggtgctgtggcccaaggttcccattctgaaggggatataaacaacactactatatttgttggagggcttgattctgataccagtgatgaggatctcagacaaccatttttgcaatttggtgaggttgtctctgtgaaaattccagttggtaaagggtgtggatttgttcaatttgctgacagaaagaatgctgaggaagcaattcagggattgaatgggacagtaattgggaagcagacagtgcgtctttcttggggtcgcagtccaggaaataagcattggagatctgattccaatggaggccattatggtggtcatcagggttatggtggccatggatttgctgtgagacagaatcaggatatagccatgcaacctgctgctgcaattcaaggtgcttcctaacggggcttattagcagaactgtgtgttgaagtaggatggattttattgctctcccctaaactgtagtattatttttaaatttgtagctgggttaaggtatgccaggttcttaagattgtattaaaatgtctgaaattttggattgaacccgaccatataatatatgattcgggtatttttgttttttttttaaaccctcaaaacatattggtagcagacagctaagattatttaaatacttatctttacagtacaatgttactgcttgcaaaaaaaaaaaaaaaaa

SEQ ID NO: 272 - protein, 431 aa, Glycine max
MAQPSSNGDLNNNQQQGQVQQQQQQGQWAAAAQPHQYQQQWMAMQYPATAMAMMQQQMLMYPQHYMPYAHPHYPPPPPPPPSSHHHHHHKQAAASSDEIRTVWLGDLHHWMDENYLHNCFAHTGEVVSAKVIRNKQTGQSEGYGFVEFYSRGTAEKVLQNYNGTMMPNTDQAFRLNWATFSAGEGRSSDATSDLSIFVGDLAIDVTDAMLQDTFAGRYSSIKGAKVVIDSNTGRSKGYGFVRFGDENERTRAMTEMNGVYCSSRPIRIGVATPKKTYGFQQQYSSQAVVLAGGHSANGAVAQGSHSEGDINNTTIFVGGLDSDTSDEDLRQPFLQFGEVVSVKIPVGKGCGFVQFADRKNAEEAIQGLNGTVIGKQTVRLSWGRSPGNKHWRSDSNGGHYGGHQGYGGHGFAVRQNQDIAMQPAAAIQGAS

SEQ ID NO: 273 - DNA, 1583 bp, Glycine max
gcacgaggtcatcagtcatcaccgttgattgattaagatgcagcaatcaaacggctctgattcgtccacgacggagcagaaagcgccgccgccgaggcaatcaccggcggtggcgaggccgcagcaatggctgccgatgcagtaccctgcggcggcgatggtaatgccgcaccacatgttgccgcctcagcattacgcgccgccgccctacgtgcccttccaccaccaccaccaccatcaccagtacgcggcgccgcacgtgccgaaccaacatcagcagcagcagcagcatcaccaccatcagaacggatccggcggcgagaacaaaaccatctggatcggcgatttgcatcactggatggacgaaaactatctccatcgctgtttcgcttccaccggcgagatttcctccatcaaggttattcgcaataagcaaactggcttatcagagggttatggatttgtggagttctattcacatgctacagctgagaaagttttgcaaaattatgctggaattttgatgcccaatactgagcaaccattccgtctgaactgggcaacatttagcacaggagacaagggttcagataatgttcctgacctttctatttttgtaggagatttagctgcagatgttacagatagtttgttgcatgaaacttttgctagtgtatatccttctgttaaagctgcaaaagttgtttttgatgccaatactggccgttcaaagggctatggtttcgtcaggtttggagatgacaatcagagaacccaggccatgactcagatgaatggtgtttactgttctagcaggcctatgcgtattggagctgcaactccaaggaaatcatctggccatcaacaaggtgggcagtcaaatggcacagccaaccaatctgaagcagattctacaaacacaactatatttgttggaggactcgaccctaatgtttcagatgaagatctcaggcagccattctcccagtatggtgagatagtctctgttaagatacctgttggaaagggctgtggttttgtccaattcgcaaacagaaataatgctgaagaggccttgcagaagctaaacgggacatcgattggcaagcaaacagttcgtctttcttggggccgtaatccagcaaataagcagtttagaatggatttcggcaacccctggactggggcatattatggggcccctatgtatgatggctatgggtacgcattgacccctcgtcatgatcccagcatatatgctgctgcttatggggcttaccccctttatggaggccaccaacaacaagtaagctgaacgaagtgcagtacagtgctggagtaccattcacaacaagttagacagtatcgagcttgaatgtgcaaattaagtttctctgttttaacttgcttgatctgttgaattcttaagacaagaatccctcctaattgtggagcggagatgaattttgatagcctgaggtagctctgtaggggattcaattagtcatttgtttaggcctgtaggagtaatgactaatgaggaccttaaacttattataggaaaaaaaaaaaaaaaaaaaaaa

SEQ ID NO: 274 - protein, 425 aa, Glycine max
MQQSNGSDSSTTEQKAPPPRQSPAVARPQQWLPMQYPAAAMVMPHHMLPPQHYAPPPYVPFHHHHHHHQYAAPHVPNQHQQQQQHHHHQNGSGGENKTIWIGDLHHWMDENYLHRCFASTGEISSIKVIRNKQTGLSEGYGFVEFYSHATAEKVLQNYAGILMPNTEQPFRLNWATFSTGDKGSDNVPDLSIFVGDLAADVTDSLLHETFASVYPSVKAAKVVFDANTGRSKGYGFVRFGDDNQRTQAMTQMNGVYCSSRPMRIGAATPRKSSGHQQGGQSNGTANQSEADSTNTTIFVGGLDPNVSDEDLRQPFSQYGEIVSVKIPVGKGCGFVQFANRNNAEEALQKLNGTSIGKQTVRLSWGRNPANKQFRMDFGNPWTGAYYGAPMYDGYGYALTPRHDPSIYAAAYGAYPLYGGHQQQVS

SEQ ID NO: 275 - DNA, 1537 bp, Glycine max
cgagactcaatctctttctctctctttctttgccctctctttctctctctagaattctcagatttgcggggcgagatgatgcagcagccaggacccggcatggcacctcccaccatgggccagcagccgccgcaacagtaccagcagcctccgccgcagcagcagcaaccctacgtcatgatgccgccgcaggcccaggccccgcaggccatgtgggccccctccgcccagcctccgcctcagcagcagcccgccagcgccgacgaggtccgaaccctctggatcggggatctgcagtactggatggacgagaactatctctatacctgctttgctcacaccggcgaggttacatcggttaaagtaattcgaaacaagcaaactagtcaatctgaaggttatgggtttattgagtttaatagtcgtgctggagctgagagaattcttcaaacatataatggggcaataatgccaaatggggggcagagtttcaggttgaattgggcaacttttagtgctggtgagaggtcgcgccacgacgattctccagattacaccatatttgttggtgacttggctgcagatgttactgattatcttcttcaggagacatttagggctcgttataactcggtgaagggtgcaaaagttgtcattgataggctaactggccggaccaagggatatggctttgtaaggttttcagatgagagtgagcaagtgagggctatgactgagatgcaaggggttctttgctcaacaagacccatgaggattggacccgcctctaataaaacccccaccactcagtcccagcccaaagcttcatatcagaattctcaacctcaaggttcacagaatgagaatgatccaaataatacaactatttttgttggtaatttggatcctaatgtcactgatgatcatctgaggcaagttttcagccagtatggagaattagtgcatgtgaagattccagcaggcaagcgatgtgggtttgtccaattcgcagacaggagctgtgctgaagaggcacttcgggtgttgaatgggaccctgttgggtggtcaaaatgttcgtctttcatggggtcgcagtccttcaaacaaacaggctcaggcagatccaaaccagtggaatggtggtgctggttctggtggtggatactatgggtatgctgcacaaggttatgaaaattatgggtatgctcctgctgctggacaggatcccaacatgtatggcagttatccggggtatcctggttaccaaccacctcagcaacagcaacaaataggatatagttgagaagagaatgttccttttcttctgtaatcttttgtgatacttatcgagttgcgtgtctcttctcgtctcgtggaaaaccgactctgctactctttttcttttttccccttgtttgcttaataacattaaattttatcggagccgccttttgtatccataaattgcttgctgaatacttatttatgaaatgatctctattatgcattatgattttaaaaaaaaaaaaaaaaaa

SEQ ID NO: 276 - protein, 409 aa, Glycine max
MMQQPGPGMAPPTMGQQPPQQYQQPPPQQQQPYVMMPPQAQAPQAMWAPSAQPPPQQQPASADEVRTLWIGDLQYWMDENYLYTCFAHTGEVTSVKVIRNKQTSQSEGYGFIEFNSRAGAERILQTYNGAIMPNGGQSFRLNWATFSAGERSRHDDSPDYTIFVGDLAADVTDYLLQETFRARYNSVKGAKVVIDRLTGRTKGYGFVRFSDESEQVRAMTEMQGVLCSTRPMRIGPASNKTPTTQSQPKASYQNSQPQGSQNENDPNNTTIFVGNLDPNVTDDHLRQVFSQYGELVHVKIPAGKRCGFVQFADRSCAEEALRVLNGTLLGGQNVRLSWGRSPSNKQAQADPNQWNGGAGSGGGYYGYAAQGYENYGYAPAAGQDPNMYGSYPGYPGYQPPQQQQQIGYS

SEQ ID NO: 277 - DNA, 1674 bp, Glycine max
gcacgaggaaagaataaaataatgttaaagtatttatgtagtgaaaaagattgagtaggcagaggggatggcgagctaccagcaggcatcaacaatcgaggaagtgagaaccctatggattggggatttacaatactgggtggacgaagggtacctgagccactgcttcggccacacgggagaagtaatatccatcaaaatcatccgcaacaagctcacgggccagcccgagggctacggcttcgtcgagttcgtatcccacgccgcagccgagagggttctccagacctacaacggcacccaaatgcccgccactgaccagaccttcaggctcaactgggcctccttcggcattggtgagcgcaggcccgatgccgcccctgaacactccatcttcgtcggcgatctcgcccccgacgtaaccgattaccttctccaggaaacttttcgcgctcactacccttccgttcgcggcgccaaagttgtcaccgaccccaacaccgcccgctccaagggttacggcttcgttaagttttctgatgagaatgaacggaaccgcgccatgactgaaatgaacggcgtttattgctccaccaggcccatgcgtattagtgctgctacgcccaagaaaaccaccggtgcttatgctgcacccgccgcgcctgtgcccaaacctgtgtatccggttccggcctatacttcgcctgttgttcaagttcaaccacctgactatgatgtcaataatactaccatttttgttggtaatttggatcttaatgtgtcagaggaggagctgaagcaaaactctctgcaatttggggaaattgtttctgtcaaaattcagcctggcaagggatttggttttgttcaatttgggaccagagcatctgctgaagaagccattcagaagatgcagggaaagatgataggccaacaagtggtacggatttcttggggtaggactctaacagctagacaggacttacctggtggctggggaccacagatggatccaaatcaatggagtgcctactatgggtatggacagggttatgaagcctatgcttatgggcctgctcatgatccttcattgtatgcatatggtgcatatcctggctatgcacaatacccccaacaggttgaaggtgctcaagacctatcgggtatgtctgtgcctaccatggaacaaagggaggaattgtatgatccattggcaatgcccgatgttgataaattaaatgctgcatacctctcagtacatggaagtgccattttaggacggtcgctttggcaaaaaacctgttcgtcatccttacagcaagcttaagatctaattgtcctgcctggtcaattatgtgcattatatgacaatattctgcatagatttaaattcttgttaatacatacttgagttgatcccaatacattttttcttaaacacaactttgttggtgtaaagaatgtggaagcggatcctctccagcacctaccgtctccagctccctcctgcatcattgtcagccgttggatacaagtaaatgatgagtgttttaaaggttagaaagtcatacctagaaaaaaacattaagtaatgaataagttttttttttatcattaagtaatgaataaatttgatcctctcagtcggatgagaaaaaaaaaaaaaaaaaaaaa

SEQ ID NO: 278 - protein, 419 aa, Glycine max
MASYQQASTIEEVRTLWIGDLQYWVDEGYLSHCFGHTGEVISIKIIRNKLTGQPEGYGFVEFVSHAAAERVLQTYNGTQMPATDQTFRLNWASFGIGERRPDAAPEHSIFVGDLAPDVTDYLLQETFRAHYPSVRGAKVVTDPNTARSKGYGFVKFSDENERNRAMTEMNGVYCSTRPMRISAATPKKTTGAYAAPAAPVPKPVYPVPAYTSPVVQVQPPDYDVNNTTIFVGNLDLNVSEEELKQNSLQFGEIVSVKIQPGKGFGFVQFGTRASAEEAIQKMQGKMIGQQVVRISWGRTLTARQDLPGGWGPQMDPNQWSAYYGYGQGYEAYAYGPAHDPSLYAYGAYPGYAQYPQQVEGAQDLSGMSVPTMEQREELYDPLAMPDVDKLNAAYLSVHGSAILGRSLWQKTCSSSLQQA

SEQ ID NO: 279 - DNA, 1277 bp, Glycine max
tttgtgtcgcctggtcttggcatctccgcagcaccacccaccctggaccaggtcttcaacagagagaaagagaaggaagaacacacacacacacacacacacgttaaactaacattttttattagtaagaagacatggctcaacccagttccaacggggatctgaataataaccagcagggtcaggttcagcaacagcagcagcagtgggcggcggcgcagccgcatcagtatcagcagcaatggatggccatgcagtacccggccacagccatggccatgatgcagcagcagatgatgatgtacccgcagcattacatgccctacgctcacccccattatccgccgccgccgccgccgccgcctcctcagtcgtctcaccatcaccaccacaaacaggccgcagccgcggcggcggctgcggcctcctccgacgagatcaggaccgtctggctcggcgacctccaccattggatggacgagaactacctccacaactgctttgctcacaccggcgaggttgtgtcggccaaggtcattcgaaataagcaaactggtcagtctgagggatatggattcgtggagttctattcacgagcgacggctgagaaagtcttgcagaactataatggcacgatgatgcccaatacagatcaggcattccgtctgaattgggccacattcagtgcgggggaaaggcgttcttccgatgctacttctgatctctctatatttgtgggggacttggccattgatgttactgatgctatgctgcaagagacttttgctggccgatattcatctattaagggagcaaaagttgtcattgattctaataccggccgctcaaaaggctatggttttgttaggtttggtgatgaaaatgagagaacgagggcaatgactgaaatgaatggtgtttattgttctagtaggcccatgcgaataggtgttgcaactcccaagaaaacttatggctaccaacaacaatattcttctcaagctgtgctattggccggtggacacgcagctaatggtgctgtggcccaaggttcccattctgaaggggatttaaacaacaccactatatttgttggagggcttgattctgacaccagtgatgaggatctcagacaaccatttttgcaatttggtgaggttgtctctgtgaaaattccagtgggtaaagggtgtggatttgttcaatttgcagacagaaagaatgctgaggaagcaattcacgcattgaatgggacagtaattgggaagcagacagtg

SEQ ID NO: 280 - protein, 381 aa, Glycine max
MAQPSSNGDLNNNQQGQVQQQQQQWAAAQPHQYQQQWMAMQYPATAMAMMQQQMMMYPQHYMPYAHPHYPPPPPPPPPQSSHHHHHKQAAAAAAAAASSDEIRTVWLGDLHHWMDENYLHNCFAHTGEVVSAKVIRNKQTGQSEGYGFVEFYSRATAEKVLQNYNGTMMPNTDQAFRLNWATFSAGERRSSDATSDLSIFVGDLAIDVTDAMLQETFAGRYSSIKGAKVVIDSNTGRSKGYGFVRFGDENERTRAMTEMNGVYCSSRPMRIGVATPKKTYGYQQQYSSQAVLLAGGHAANGAVAQGSHSEGDLNNTTIFVGGLDSDTSDEDLRQPFLQFGEVVSVKIPVGKGCGFVQFADRKNAEEAIHALNGTVIGKQTV

SEQ ID NO: 281 - DNA, 1525 bp, Glycine max
gcacgagggaggctgaagcataatcagcgcggcggtgtaagatggtggcaacggcgatcgaggaagtgcgaaccctctggattggcgatttacagtactgggtcgacgagtcctacctctctcagtgcttcgcccacagcggcgaagtggtttccatcaaaatcatccgcaacaagctgacgggccagcccgagggctacggcttcgtcgagttcgtctcgcacgcctcggccgaagcctttctccgaaccttcaacggggcccaaatgcccggcacggaccagaccttcaggctcaattgggcctcgttcggggactccgggcccgaccactccatcttcgtcggcgatctcgcccccgacgtcaccgatttcatcctccaggagactttccgggcccattatccctccgttaaagggtccaaagtcgtcaccgaccccgccacgggccgctccaagggctatgggtttgttaagttcgccgatgaggcccagaggaaccgcgccatgactgaaatgaacggcgtttattgctccacgcgcccaatgcgtatcagcgcggctactcctaagaagaatgcttcttttcaacaccaatatgctccacctaaagcaatgtatcaatttcctgcatacactgctccagtgagtactgttgcgccggagaatgatgtgaataataccactgtttgtattggtaatttggatcttaatgtgacggaggaggagcttaagcaagcctttgtgcaatttggtgatattgtgttggtcaaaatttatgcgggcaaaggatatggttatgttcaatttggaactagagcgtctgctgaagatgccattcagaggatgcaagggaaggtaataggtcagcaagtgatccaaatttcttggggcagtaccttgacagctagacaggatgtacccggtggctggggtgcacagatggatccaagtcaatggagtgcttactacggatatggacagggttatgaatcatatgcttatggtgctactcatgatccctccttgtatgcttatggtgcatatgccggttatgcacaataccctcagaatgttgaaggtgctcaagacatgtcagcagtgtctatgcctatggaggaattgtatgaccccctggcaatgcctgatgtcgataaattaaatgctgcatatctttcaatacacggaagttctattttagggcggtccctttggcagagaacttcacaatctttacagcaagcctaggatctatatgtattgtcaggtcaattttaggcattaaggcttcaaaatatggctgtcttacaattttgcgtttgtttcaacatgagtggaagagcatgttaattagatcaatggtagtattttatgatgtaatactgaatatcaatgattttattttagtttaggatttgagttttaatagtaatcttgtattaaaatttagatatgatgtcataaggatattgtgtcgtaattttcagaatttgttgtaaaaaaaaaaaaaaaaaaaaaaaaaaaaa

SEQ ID NO: 282 - protein, 401 aa, Glycine max
MVATAIEEVRTLWIGDLQYWVDESYLSQCFAHSGEVVSIKIIRNKLTGQPEGYGFVEFVSHASAEAFLRTFNGAQMPGTDQTFRLNWASFGDSGPDHSIFVGDLAPDVTDFILQETFRAHYPSVKGSKVVTDPATGRSKGYGFVKFADEAQRNRAMTEMNGVYCSTRPMRISAATPKKNASFQHQYAPPKAMYQFPAYTAPVSTVAPENDVNNTTVCIGNLDLNVTEEELKQAFVQFGDIVLVKIYAGKGYGYVQFGTRASAEDAIQRMQGKVIGQQVIQISWGSTLTARQDVPGGWGAQMDPSQWSAYYGYGQGYESYAYGATHDPSLYAYGAYAGYAQYPQNVEGAQDMSAVSMPMEELYDPLAMPDVDKLNAAYLSIHGSSILGRSLWQRTSQSLQQA

SEQ ID NO: 283 - DNA, 541 bp, Triticum aestivum
tcgcatccgcatcagccgccgccggaaccggggaggcggcgatacgtcgcgatgcagccaacataccagccgccaatgaacggccagcacgcgcctcagccgaaggcctctggggctccgccgcctcctctgcagcaggcacccccgccgcagcagtactaccaggcgccgccgcagtactaccagcagggacccccgccggcgatgtggggccacccgcagcagcatatgcctccgcagtacgcgcctccgccgcagcagtacgcgcctcagcctcctcagcagtacgcgccgccgccgcagcattacgcgccgccgccgccgcagtacggagcgcagatggctggcgggccgcctcccggaggcgaggatatcaggtcgctgtggatcggagatctccagtactggatggatgagacctacctctacaacgcctttgcgcctgtggggccgcagcaggtcacctcagtgaaaattatccgcaacaaacatactgggcagcctgagggttatggttttattgaatttcactgaggtgacc

SEQ ID NO: 284 - protein, 176 aa, Triticum aestivum
SHPHQPPPEPGRRRYVAMQPTYQPPMNGQHAPQPKASGAPPPPLQQAPPPQQYYQAPPQYYQQGPPPAMWGHPQQHMPPQYAPPPQQYAPQPPQQYAPPPQHYAPPPPQYGAQMAGGPPPGGEDIRSLWIGDLQYWMDETYLYNAFAPVGPQQVTSVKIIRNKHTGQPEGYGFIEF

SEQ ID NO: 285 - DNA, 1160 bp, Triticum aestivum
gcacgagctagtctcgagctgctgcggaatatgctctggggacctttaatgggcagatgatgcctaatgttgaacaagtttttaagctaaactgggcttcttgtagtgctggtgacaagcggggtgacgatggttctgatcacacaatatttgttggtgatttggctgctgatgttactgacgccatgttggaagagatattcaaagccacctacccatcagttaaaggtgctaatgttgttactgacagggccactggtcgctccaaaggatatggttttgtacgctttggagatctaaatgagcagacacgtgctatgactgagatgaatggagtgccattgtctacaagacaaatgaggattgggcctgcagctaacaagaagaatataggtactcagcagacatattcaactaatgggtaccagagctctcaagtaaatgaggcggcgaatgatcccaacaatactacaatctttgtgggcgggttagattccaatatagatgagaactatctaaggcaagtttttactccatatggcgaagttggttatgtgaagattcctgtaggcaagcgttgtggatttgtccaatttaccagcagggcgtgcgctgagcaggccatcagtgcgctgaatgggtctcagattggtagttccaatgttcgcctttcatggggccgtagccaaaacaaacagcctccccagcaggatgcaaaccagggtaatggcaacagctactatggatatcaacagggtcctgatgcatactatggtgcacccaatgcgcaagatcctagcatgcaaaactatggatactctggttatggcagttacgagcagcaacagcagccatctcagcagcagcaacctccacagcagcagccaccacagcagcaacagcagcagcccccacagcagtgaccattgaggcgatggagcgcaatcagagattcagagctgcatgaactgaatgctaccgcgtcatgagttatcgtataggtgtccttgtttgtaagatgggtcgtatctagtagtactttgactgttgggcagtagctctagttctattcagtgcttctcttggttttaaattatcgaactatgtccatgactgagttaagcttttaatgttattttggatcaccaggttctaaaaaa

SEQ ID NO: 286 - protein, 288 aa, Triticum aestivum
MMPNVEQVFKLNWASCSAGDKRGDDGSDHTIFVGDLAADVTDAMLEEIFKATYPSVKGANVVTDRATGRSKGYGFVRFGDLNEQTRAMTEMNGVPLSTRQMRIGPAANKKNIGTQQTYSTNGYQSSQVNEAANDPNNTTIFVGGLDSNIDENYLRQVFTPYGEVGYVKIPVGKRCGFVQFTSRACAEQAISALNGSQIGSSNVRLSWGRSQNKQPPQQDANQGNGNSYYGYQQGPDAYYGAPNAQDPSMQNYGYSGYGSYEQQQQPSQQQQPPQQQPPQQQQQQPPQQ

SEQ ID NO: 287 - DNA, 1344 bp, Triticum aestivum
gcacgagagcaaactggacagcttcagggctatggctttgtcgagtttgcaagccatgcagcagctgagcgagttcttcagacattcaatggtcaaatgatgccaaatgttgagttggcatacagactgaactgggccagtgctggtgaaaagcgtgatgataccccggactatacaatctttgttggggatttggcagctgatgttacagactacatgttacaggagacattcagggtacattacccttcagtaaagggcgcaaaggttgtcactgacaagatgacaatgcgttcaaagggttatgggtttgtgaagtttggtgatcctacagagcaagctcgtgccatgactgaaatgaatggaatgccctgttcttccagacctatgcgcattggcccagcagcaaataggaagacaacaggggttcaggagagagtaccaattccaaatacaaatactcaaggagctcagtctgacaatgatcctaacaataccaccatatttgttggtggccttgaccccaatgtcactgaagatgccttgaaacaagtgtttgctccatatggggaagttgtccatgtcaagatccctgttgggaagagatgtggctttgttcagtatgctaacaggccttctgctgagcaagctctgcaattgctgcaagggaccttggttggtggtcagaatgtgaggctttcatggggacgaagcccttcaaacaaacaaactcagcctcaggaagccacccagtggggtgcaggtgctgctgctggtgctgctggtggttactatgctggatatggacaaggctacgaggcttatggacaagggtatgcacagcctcaagaccctaacatgtatggttatggagcctatgctggttatcccaactaccaacaaccagcagcggcaccgcagccaccgccaccacaacagtgagctctcctcgttgggtcgtccagacagatgagaacccctgtttgaaggcactgtcaaggctaatgttgtagcacctgtcgatagagagagacggttcctggactccggattttgattgccccatggcaaggtctattgttctgttattatgcactatgttatgatcagctgttgtccgtcccattgtggtgatcctttggatatgtacttggaaacttagctttgtttcgccgcatgtccttgtctactgttatttaccattgctatcttgtgctgttaaattatatactattgtaccgtttgcttccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 288 - protein, 311 aa, Triticum aestivum
EQTGQLQGYGFVEFASHAAAERVLQTFNGQMMPNVELAYRLNWASAGEKRDDTPDYTIFVGDLAADVTDYMLQETFRVHYPSVKGAKVVTDKMTMRSKGYGFVKFGDPTEQARAMTEMNGMPCSSRPMRIGPAANRKTTGVQERVPIPNTNTQGAQSDNDPNNTTIFVGGLDPNVTEDALKQVFAPYGEVVHVKIPVGKRCGFVQYANRPSAEQALQLLQGTLVGGQNVRLSWGRSPSNKQTQPQEATQWGAGAAAGAAGGYYAGYGQGYEAYGQGYAQPQDPNMYGYGAYAGYPNYQQPAAAPQPPPPQQ

SEQ ID NO: 289 - DNA, 636 bp, Triticum aestivum
ctcgtgccgaattcggcacgagatccgcaatagacattccggagtttctgagggttatggttttgtagagttctgttcccatgcatcagcagagaaagcacttcagaattttgctggtcatgtaatgcctaatactgaccgagcttttaagttaaattgggcatcgtatagtgttggagaaaaacgctctgaacttgcttctgatcactcaatttttgttggtgatctagctgttgatgttactgatgacatgttgatggaactttttgctaacaaatatcgttctgtgaaaggagctaaagttattattgatgcaaacacgggccgttctaggggctatggatttgttaggtttggagatgatattgatagaactcatgctatgactgaaatgaatggtgtgtattgctccactcggccaattcgcattgcacctgcaactcctagaagaacttcagtttcaggtgattttggcacctctccaccaacacaatcagatggtgactcgactaacaggacagtatatgttggcgggcttgaccccaacgttagtgaagatgaactaaggaaagcatttgcgaaatatggtgatgttgcttctgtcaaaattcctgttgggaaacaatgcggttttgt

SEQ ID NO: 290 - protein, 214 aa, Triticum aestivum
SCRIRHEIRNRHSGVSEGYGFVEFCSHASAEKALQNFAGHVMPNTDRAFKLNWASYSVGEKRSELASDHSIFVGDLAVDVTDDMLMELFANKYRSVKGAKVIIDANTGRSRGYGFVRFGDDIDRTHAMTEMNGVYCSTRPIRIAPATPRRTSVSGDFGTSPPTQSDGDSTNRTVYVGGLDPNVSEDELRKAFAKYGDVASVKIPVGKQCGFVSC

SEQ ID NO: 291 - DNA, 1508 bp, Zea mays
ccacgcgtccgcgtccgtctccgctcctccgcaaccccttcccctcctccgccgaagcctctcctccggccgccgaaaccctagcctccgccgctgccgtcatggcaagcagcaacgtctcgaccgtttacatctctgtcattgatgacgtcatctccaaggtccgcgaggatttcatcacctacggagtcggtgacgccgtcctaaacgagctccaggctctctgggagatgaaaatgctacactgtggcgcgatctcggggaacatagaccgaaccaaggctgctgccgcgtccgtcggaggcaccaccggcacgacaccgcccgtgcacgacctgaacgtgccgtacgaggccacatctgaggagtacgccaccccgaccgctgacatgttgttcccgccgacaccattgcagaccccaatccagactcctctgccagggacagacacagcgatgtacaacatacccactggcccttccgattatgccccctcaccgatcagcgatgtcaggaatgggatggcaataaatggggcagacccaacagctggtcatccaagtccctacatgccaccaccttccccttggatgaatcagaggccgctgggtgttgatgtgaatgtcgcttatgtggaaggccgtgaagatcctgacaggggcgtgcagcctcagccactgactcaggattttttgatgatgtcttctgggaaacgcaagagggatgagtatcctggtcagctcccttctggttcttttgtaccacaacaagatggaagtgctgatcagatagtagaatttgttgtgtcaaaggaaaatgcgaatcaactttggagttccatcggcaataagcttgaaacaccaaccaagacaatcactccagttattccgcagcgtgatgggattcaagataactacaatgatcaatttttctttccaggagttccaaccgaagattataatacccctggagaatctgcggagtatcgagctcctacacctgctgttggaacaccaaaacaaagaaatgatgctggagatgatgataatgatgatgatgatgatgaacctcctcttaatgaagacgacgacgaggagttagatgaccttgagcaaggggaggatgaacctaacacacaacatcttgtacttgcacaatttgataaagtgtcaaggaccaagaatcgttggaagtgcaccttgaaggatggaatcatgcatttgaatggcagggatgtcctttttaacaaggcgacaggtgagtttgatttttgattttttggatgaagatgagctattttagaagcagctgtatggacatatctttgtcttgacataaggacagggaggtgacagtgttcttggtggggtcctggcagcatgactgcgtcgtgttttctttcctattgaatcttcgttccaccctcttgtttgtcaccgcaactgttatcgctgtaaagaagttactgcttgtgctgtgtagacaatttctgaaaaaaaaaaaaaaag

SEQ ID NO: 292 - protein, 390 aa, Zea mays
MASSNVSTVYISVIDDVISKVREDFITYGVGDAVLNELQALWEMKMLHCGAISGNIDRTKAAAASVGGTTGTTPPVHDLNVPYEATSEEYATPTADMLFPPTPLQTPIQTPLPGTDTAMYNIPTGPSDYAPSPISDVRNGMAINGADPTAGHPSPYMPPPSPWMNQRPLGVDVNVAYVEGREDPDRGVQPQPLTQDFLMMSSGKRKRDEYPGQLPSGSFVPQQDGSADQIVEFVVSKENANQLWSSIGNKLETPTKTITPVIPQRDGIQDNYNDQFFFPGVPTEDYNTPGESAEYRAPTPAVGTPKQRNDAGDDDNDDDDDEPPLNEDDDEELDDLEQGEDEPNTQHLVLAQFDKVSRTKNRWKCTLKDGIMHLNGRDVLFNKATGEFDF

SEQ ID NO: 293 - DNA, 1556 bp, Zea mays
ccacgcgtccgtccgcatccctcgccttcctccgcccaagcctctgttctcctccggctgccgaaaccctagccgcctccgccgtcatggcgagcagcaacgtctccaccgtctacatctccgtcatcgatgacgtcatctccaaggtccgcgaggatttcatcacctacggagtcggcgacgccgtcctaaacgagctccaggctctctgggagatgaaaatgctgcactgtggcgcgatctcggggaacatagagcgaaccaaggctgccgcggcttctgccggaggcacctccggcacgacaccgccagtgcacgacctcaacgtgccgtacgaggccacatccgaggagtacgccaccccgaccgctgacatgctgttcccgccgacaccattgcagaccccaatccagactcctttgccagggacagacacagggatgtacaacatacctactggcccttccgattatgccccatcaccgatcagcgatatcaggaacgggatgacgataaatggggcagacccaaaagctggccgtccaagtccttacatgccaccaccttccccttggatgaatcagaggccgctgggtgttgatgtgaatgtcgcttatgtggaaggtcgtgaagatcctgacaggggcgtgcagcctcagccactgactcaggactttttgacgatgtcttctggaaaacgcaagagggatgagtatcctggtcagctcccttctggttcttttgtaccacagcaagatggaagtgctgatcagatagtagaatttgttgtgtcaaaggaaaatgcaaaccaacattggagttccatcatcaacaagcttgaaacaccaaccaagacagtcactcctgttattccgcagtgtgatgggattcaagatgactacaatgatcaatttttctttccaggagttccaactgaagattataatacccctggagaatctgctgagtatcgagctcctacacctgctgttggaacaccaaaaccaagaaatgatgctggagatgataatgatgatgacgatgatgatgaagaacctcctcttaatgaagacgacgacgacgacgatgatttagatgaccttgaggaaggggaggatgaacctaacacacaacatcttgtacttgcacaatttgacaaagtgacgaggaccaagaatcgttggaagtgcactttgaaggatggaatcatgcatttgaatggtagggatgttctatttaacaaggcgacaggtgagtttgatttttgactttttggatgaagatgagctattttagaagcagctgtatggacatatcttgtcttagacataaggacggggaggtgacgaagtgttcttggtggggtgctggcagtatgactgcgtcgtgttttcctattgagactttgtttcaccctcttgtttgtcaccgcaattgttatcgctgtaaagaagttaccgcttgtgctgtggacattttctgagatgggtgtctcacatccgcagcgtaactaatgctagttatacatttttgtctctaaaaaaaaaaaaaaaaag

SEQ ID NO: 294 - protein, 393 aa, Zea mays
MASSNVSTVYISVIDDVISKVREDFITYGVGDAVLNELQALWEMKMLHCGAISGNIERTKAAAASAGGTSGTTPPVHDLNVPYEATSEEYATPTADMLFPPTPLQTPIQTPLPGTDTGMYNIPTGPSDYAPSPISDIRNGMTINGADPKAGRPSPYMPPPSPWMNQRPLGVDVNVAYVEGREDPDRGVQPQPLTQDFLTMSSGKRKRDEYPGQLPSGSFVPQQDGSADQIVEFVVSKENANQHWSSIINKLETPTKTVTPVIPQCDGIQDDYNDQFFFPGVPTEDYNTPGESAEYRAPTPAVGTPKPRNDAGDDNDDDDDDEEPPLNEDDDDDDDLDDLEEGEDEPNTQHLVLAQFDKVTRTKNRWKCTLKDGIMHLNGRDVLFNKATGEFDF

SEQ ID NO: 295 - DNA, 1612 bp, Oryza sativa
gcacgagtctctccttaattccccatctctctcgtccgcctccctcctcctcttccccccctcttcttccccaactcgccgccgtcctgcccgcctccaccctttcgcctcctcgttccccgcacccaaaccctaatcctagccgccgctgccgctgccgctgccgccgccatggccagcagcaacgtctccacggtctatatctccgtcatcgacgacgtcatctccaaggtccgcgacgacttcatctcgtacggcgtcggcgacgctgtcctcaacgagctccaggcgctctgggagatgaagatgctgcactgcggcgcaatctccgggaccatcgaccgctccaaggcggctcccgcgccgtccgcaggcacccccggcgctggaaccaccccgccggtacacgacctaaacgtgccctacgaggccacctcggaggagtacgccacccccacagcggacatgctgttccccccgacgccgctacaaaccccgatccagacccctcttccaggaacagatgcagggatgtacaacattcccactgggccttcagactatgccccttccccgatcagtgacgtgaggaatggcatggccatgaatggagctgatccaaagactggtcgcccgagtccctacatgcctccaccctctccctggatgactcagaggccgctgggcgttgatgtgaatgtcgcttatgtggagaaccgtgaggacccagataggaccggacagcctccgcaactaactaaggattttctaatgatgtcctctgggaaacgcaagagggatgaatatcctggtcagctcccttctggttcttttgtgccacaacaagatggaagtgcagatcagatagttgaatttgttgtctcaaaggacaacgcacaacaactttggagttccattgtgaacaagcaaggaacagcaacaaaagaatcttccacaaaggaaacaataattgctccaacgattcctcaacgggatgggatggatgactataatgatccattttacttccaaggagttccaactgaggattacaatacccctggagaatcgtcggaataccgagctcccacaccggctgttggaacaccaaaaccgagaaatgatgtaggcgatgatgatgagcctccgcttaatgaagatgacgatgatgatgatgagttagatgaccttgagcaaggggaggatgagcctaacacacagcaccttgtcctcgcacagtttgacaaagtgacaaggacaaagaaccgctggaaatgcactttgaaggatggaatcatgcatttaaatggccgagatgttctattcaacaaggctaccggcgaatttgatttttgaattttgtgacaaagaggagctattttagaagctgctgtatcgacatatctttgtctttgacataagagtggggaatgacaaaagcactggtggggggtgggtttgttcctgtggaggctttgctctacccagtgggtttgttaccgtaactgttatcgctgtaaaaaaaaatgctacagttgggactgttgtagacattttcctgagatggttatcttaaagttggcggaggattaaaaaaaaaaaaaaaaaaaaa

SEQ ID NO: 296 - protein, 394 aa, Oryza sativa
MASSNVSTVYISVIDDVISKVRDDFISYGVGDAVLNELQALWEMKMLHCGAISGTIDRSKAAPAPSAGTPGAGTTPPVHDLNVPYEATSEEYATPTADMLFPPTPLQTPIQTPLPGTDAGMYNIPTGPSDYAPSPISDVRNGMAMNGADPKTGRPSPYMPPPSPWMTQRPLGVDVNVAYVENREDPDRTGQPPQLTKDFLMMSSGKRKRDEYPGQLPSGSFVPQQDGSADQIVEFVVSKDNAQQLWSSIVNKQGTATKESSTKETIIAPTIPQRDGMDDYNDPFYFQGVPTEDYNTPGESSEYRAPTPAVGTPKPRNDVGDDDEPPLNEDDDDDDELDDLEQGEDEPNTQHLVLAQFDKVTRTKNRWKCTLKDGIMHLNGRDVLFNKATGEFDF

SEQ ID NO: 297 - DNA, 1673 bp, Glycine max
tttctctctcttcgccgttggtttcactcagctctcactctcatactaaaccctagcctcgcaattttccatgattcctctcgatctcttccactgaaatctctctcaaatcgatcgtataaggagaattatctgagacactcgcgatggcggcttccaccaccagccaggtctacatcgatgtaatcgaggatgtcatggtcaaggtccgagacgagttcgtcaacaacggtggtcctggagaggaagttctcaaggagcttcaagctatgtgggaatcgaagatgatgcaagctggcgctgtgctcgggtcccatagaaaggccagtgccgctaaggcaactcctggcggtccaattactccggttcatgatctcaacgtgccgtatgagggtaccgaggagtatgagactcctacagctgatatgctttttccccctacgccattgcaaactccaattcaaacccctttaccgggaactggggataactcaacgtataacattcctactggagcaaatgactacccctcttccggaaatgatacaggaggaaatgctgatggaaaaggagcaagacctgctccatatatgcaaccttcttctccttggatgaaccaaaggcctccacttgatgtcaatgttgcttatgtggaagggagggatgaggcagacaaaggaacttctaatcaacctctgacacaggacttcttcacgaggacgtcagggaagcgaaaacacaatgatttgacttctcaatataatgttggtggatatatacctcagcaagatggagctggggatgctgcacatggagtttttgaaattgaggtaagtggagggggcatctccattaattcacatcacactatttccaaagaaaaaatgtcagcagatttggagaggtcgacttctagaattcctcaacttgatggaccaattccatatgatgatgatgtgctctctactccaaatatatacaattatggagaagtgttcagtgaagactacaacatttctaatacaccagctcctcctgaagtaccagcaagcactcctgctctcttggctcagaatgaagtaggtaatgattttgatgatgatgatgatgatgaacctccattaaatgaagaggatgatgatgatttagatgacatggaacaaggagacgatcaaaatacacatcatcttgttttggcccagtttgataaggtggcacgtaccaagagcaggtggaaatgcacattaaaggatggcatcatgcacataaataataaggacattctcttcaataaggcgacaggagagtttgaattctgatttttgttggagctggtgctttcgtcaaacatgattcggaggtgtcattgagtgtttcatgatctttttttgattataatattattaggtgaaagattgatgaagagagaaatatttttaccctttggagactattttgatgttggcctcttgtcatagagaatgagcaatttttggcctttaactggtggttagagactcaggcattttctttaagcccgccatttgtcaagtatgtggttctttagttctgtatacttggacattttggtgaatttaagaatccttgtatgataatgataggcttggtaggcctcgcgtaacttttggacccttaaaaaaaaaaaaaaaaaa

SEQ ID NO: 298 - protein, 390 aa, Glycine max
MAASTTSQVYIDVIEDVMVKVRDEFVNNGGPGEEVLKELQAMWESKMMQAGAVLGSHRKASAAKATPGGPITPVHDLNVPYEGTEEYETPTADMLFPPTPLQTPIQTPLPGTGDNSTYNIPTGANDYPSSGNDTGGNADGKGARPAPYMQPSSPWMNQRPPLDVNVAYVEGRDEADKGTSNQPLTQDFFTRTSGKRKHNDLTSQYNVGGYIPQQDGAGDAAHGVFEIEVSGGGISINSHHTISKEKMSADLERSTSRIPQLDGPIPYDDDVLSTPNIYNYGEVFSEDYNISNTPAPPEVPASTPALLAQNEVGNDFDDDDDDEPPLNEEDDDDLDDMEQGDDQNTHHLVLAQFDKVARTKSRWKCTLKDGIMHINNKDILFNKATGEFEF

SEQ ID NO: 299 - DNA, 2558 bp, Glycine max
cttccctatccgataattgacatttcgccgccgaattttttgggaggaacaaatccacgatggcggcctcctccaccagccaggtctacatccaggtaatcgacgatgtcatgatcaaggtccgcgacgagttcgtcaacaacggtggtcccggcgatgaagttctcaaggagcttcaatctatatgggaatcgaagatgttgcaagctggtgccattgtcggccccatagaaaggtccggggcgcctaagccaacgcccggcggtccaattactcctgttcatgatcttaacatgccttatgaggggactgaggagtatgaaactcccacagcagaaatgcttttcccccctacgccattgcaaactcctcttcaaacccctttaccaggaactgtggataactcaatgtataacattcccactggacctagtgactacccgtctgctggaaatgaacctggtgaaaataatgagataaaaggtggaaggcctggtccatacatgcaacctcctccctggacgagccagaaccagaaccagagggctccacttgacgtcaatgttgcttatgtggaagggcgggatgctgcggaaagaggagcctctaatcaacctctgacacaggacttcttcatgtcctcggggaagcggaaacgtgatgaaattgcttctcaatataatgctggtggatatatacctcagcaagatggagctggagatgctgattctcaaatttttgaaattgaagtgtatggagggggcatctccattgatgcaggtcactctacttctaatggaaaaatgccagcacattcagacaggccagcttctcagattcctcaatttgatggaccaattccttacgatgatgatgtggtttctactccaaatatgtacaattatggagtgttcaatgaagactacaacattgcaaatacaccagcttcttctgatgtaccagcaagtacccctgctcctgttgctcaaaatgaggttgatgaagaagatgatgatgatgatgagcccctaaatgaaaatgatgatgatgatgatttggatgatttggatcagggagaggatcaaaatacacaccatcttgttttggcccagtttgacaaggtgacgcgtaccaagagtagatggaagtgcaccctaaaggatggtatcatgcatataaataataaggacattctcttcaataaggcaactggagaatttgaattctgattttgtcggggattggtcttgccatttttgtggcagtgctttggtgaattacaggtgccattgagtattttgtaatctttctttgattataattattaaattaaagctggaggaggaagagaaaagtccgtaatactttcgtcactgttatattgatgtgggcctgttgtacataaaggatgagcaaattttggcctttttacatggataggtactctgaggcatttcctgaagtttgccatttgtcaagttggatatgtatgtctattagctctgcatacttggacagtttaaactgcagtgactgtcgtggttagtttttagccgtcataaagaacaacgataatgtctagtgtgtttttcttggttccaacatgatctctgaactttagtccaaaaagtgaaagaaaacatgaaaatttcgggaatatgttttctacaacagcaacgttcgtcatttcttgtgtttttttggacaaaacttaaaacatggtttttaaggtcagatggcaattgtagtgttatcttggaaaccagtgccgacatttattgtacaggttactgtgttggagaacaatctaaagacatgaacctaatttttttgtcttgtgttttctagattaatagcttgtttccatttccttttttttggtcgatgaacggtacgaaaccctagaatcaatggatacagcatgttgactggtcgagaaaaggaactttcattgccaagtgaatttatgatgaaacatttaataatttgtttgtaatacaataaatgtcttttataaaaaaaatcgaagtcaactgtttcatttaaagttataaaatttaactgaaaacagaatggagttttggtaacaggtaagattctccctaatgaaatgtataaaaaaataataagaaagttgttttagtgatttatgtcgccatagctaaagggatcatagtgacaactgtgggtgagacgaaggtatgggagacgtattttacggcaacgatgaccaccgagaaatgaacgatgattgtatgtataaggaggatgtagtgatggagagcatcagaagccaacgggaaatcaaagacctcaagcgcagacaaaacaacaacaactgctgctacttctacttccttcgatgctttcactttctcacgcttctccctgctttcgtcaacttctgatgtaacctactatttgtgttatgttatcaattaactcttgaaagtttttattcccaatttagatcaaatactgtgttgcagtattcatttttattttctttggtctccaaaaaaaaaaaaaaaaaaaaaaaaaaaaaaaaaaaaaaaaaa

SEQ ID NO: 300 - protein, 389 aa, Glycine max
MAASSTSQVYIQVIDDVMIKVRDEFVNNGGPGDEVLKELQSIWESKMLQAGAIVGPIERSGAPKPTPGGPITPVHDLNMPYEGTEEYETPTAEMLFPPTPLQTPLQTPLPGTVDNSMYNIPTGPSDYPSAGNEPGENNEIKGGRPGPYMQPPPWTSQNQNQRAPLDVNVAYVEGRDAAERGASNQPLTQDFFMSSGKRKRDEIASQYNAGGYIPQQDGAGDADSQIFEIEVYGGGISIDAGHSTSNGKMPAHSDRPASQIPQFDGPIPYDDDVVSTPNMYNYGVFNEDYNIANTPASSDVPASTPAPVAQNEVDEEDDDDDEPLNENDDDDDLDDLDQGEDQNTHHLVLAQFDKVTRTKSRWKCTLKDGIMHINNKDILFNKATGEFEF

SEQ ID NO: 301 - DNA, 647 bp, Triticum aestivum
  unsure (390): n is a, c, g or t
  unsure (408): n is a, c, g or t
  unsure (441): n is a, c, g or t
  unsure (499): n is a, c, g or t
  unsure (514): n is a, c, g or t
  unsure (531): n is a, c, g or t
  unsure (545): n is a, c, g or t
  unsure (548): n is a, c, g or t
  unsure (576): n is a, c, g or t
  unsure (583): n is a, c, g or t
  unsure (587): n is a, c, g or t
  unsure (591): n is a, c, g or t
  unsure (598): n is a, c, g or t
  unsure (605)..(606): n is a, c, g or t
  unsure (629): n is a, c, g or t
  unsure (636): n is a, c, g or t
  unsure (639): n is a, c, g or t
  unsure (644): n is a, c, g or t
cccgtttcccctctctccgagctgcagcccgcctcgccgtcgttacctcccacgcaaaccctaaccctaggcaccgccgccgccatggccagcggcaacgtgtccaccgtctacatctccgtcatcgacgacgtggtcgccaaggttcgtgaggacttcattacctacggcgttggcgatgccgtcctcaacgagctccaggctctctgggaaatgaagatgctgcactgtggcgcaatctcagggaacatcgaccgcaacagggccccccccgcttccgctgggaggcgctcctggggccggcgcgactcaaccgttgcacgactcaaacgtgcctacgaaggcaactccgaggagtacgcaacccaaccgccgaatgtgttccacgangcgctgcaacccgttcanaacattcaaggattatcaggatttaaataccanggcgtcgatatccatcgcgttatgacatagaacggatggatgatggtcgatcaaaaanggcgtcagcctaatnaactcatgctgatatanaacacggggttatntanttgtacagaaactagacaaacggtgagnactaccntggnaggntttcganttttgannggagggaatccgcgcattcgtantttacanggngaaanttt

SEQ ID NO: 302 - protein, 94 aa, Triticum aestivum
MASGNVSTVYISVIDDVVAKVREDFITYGVGDAVLNELQALWEMKMLHCGAISGNIDRNRAPPASAGRRSWGRRDSTVARLKRAYEGNSEEYAT

SEQ ID NO: 303 - DNA, 531 bp, Zea mays
ataagaagccagatttcgaattccctcctcctccgcctctcccgcagtccctcccccgtcgcgatcgctctgtgctccgcctccgtccgtcaaggcctgctcttgcgccgttcctcctcgcccaatccgccaggggatggccacattcgagctctaccggaggtccaccattggcacctgcctcaccgagacgctggacgagctcgtctccagcggggccgtcagcccggagctcgccatccaggtccttgtgcagttcgacaagtccatgactgaggcgctggagatgcaggtcaagagcaaggtcagcgtcaagggccacctgcacacctacaggttctgcgacaatgtctggaccttcattctaacagatgcaaccttcaagagcgaggagattcaagaaacactgggaagggtgaagatcgtggcctgcgattccaagttgctgcagcctcagcatccataaaacaagagtcgcctgctccatacatgttcactggcgccacccaaaccttcctagttcatgtgaat

SEQ ID NO: 304 - protein, 109 aa, Zea mays
MATFELYRRSTIGTCLTETLDELVSSGAVSPELAIQVLVQFDKSMTEALEMQVKSKVSVKGHLHTYRFCDNVWTFILTDATFKSEEIQETLGRVKIVACDSKLLQPQHP

SEQ ID NO: 305 - DNA, 570 bp, Zea mays
  unsure (438): n is a, c, g or t
  unsure (456): n is a, c, g or t
  unsure (495): n is a, c, g or t
  unsure (511): n is a, c, g or t
  unsure (515): n is a, c, g or t
  unsure (554): n is a, c, g or t
  unsure (559): n is a, c, g or t
gtgacgacgaccgcgcgagcgccgccgactccctactgcatcaggtgcctcggccttcgtcgtgctctccgccggcaacgagtatagacgggcgcgcatggccaccttcgagctgtaccggaggtccaccatcggcatgtgcctcaccgagacgctcgacgagatggtctccaacggcaccctcagcccggagctcgctatccaggtcctcgtccagttcgacaagtccatgacggatgctctggagaaccaagtgaagagcaaggttactgtcaagggtcacctgcacacctacaggttctgtgacaatgtgtggaccttcatcttgacagacgcaagcttcaagaacgaggaggccacggagcaggtgggcaaggtgaagattgtggcatgtgattccaaattgctcggacaatagcctgtgtaccctcgagtcangaagaactttaagtcggnaagcgggtcttctgcggtcactgtaaccctagctacgcnagcgggtttctcgtanctgncaccctagctacgccgaaggatttattgctctctacgtngtgtnctcttttccct

SEQ ID NO: 306 - protein, 106 aa, Zea mays
MATFELYRRSTIGMCLTETLDEMVSNGTLSPELAIQVLVQFDKSMTDALENQVKSKVTVKGHLHTYRFCDNVWTFILTDASFKNEEATEQVGKVKIVACDSKLLGQ

SEQ ID NO: 307 - DNA, 807 bp, Oryza sativa
gcacgagagatttcgaattcctctctgcggctgcgctttgctcctcccctcaatcctcctctccgctctcgctctcagtctcagatcaggagggaggggatcgatattcgatcatcgatggccaccttcgagctgtaccggaggtccaccatcggtatgtgcctcaccgacacgctggacgacatggtctccagtggggcgctcagccccgagctcgccatccaagtcctcgtgcagtttgacaagtccatgactagcgctttggagcatcaggtgaagagcaaggttactgtcaagggccatctgcacacctacaggttctgcgacaatgtgtggactttcatcctaacagatgcaattttcaagaacgaagagattacagagacaataaacaaggtgaagatcgtggcctgcgattccaaattgctggagactaaagaagagtaatttgcggaagagcccatcctgcttctcttgatgctgcagacctggcgcacctgaaatataatcttgcatctgttttcctggctcgtatcatgaatctgaacagtttccatggtaggagtactagagtatcatgttcatagtttctgtctgccatccgcatcactcatggatcgatttctctcttctctgttgagtgatggaccgatttctctcctctgttgataatgaagagtgtgatgtgtgacatgagtgtgctctgtacctaatcatgctctcgccgaaggcagacctaacatttgaattctaaatctttgaacaggatgttcaaaaaaaaaaaaaaaaaaaaaaaaaaaaacggca

SEQ ID NO: 308 - protein, 109 aa, Oryza sativa
MATFELYRRSTIGMCLTDTLDDMVSSGALSPELAIQVLVQFDKSMTSALEHQVKSKVTVKGHLHTYRFCDNVWTFILTDAIFKNEEITETINKVKIVACDSKLLETKEE

SEQ ID NO: 309 - DNA, 852 bp, Oryza sativa
agaaatctggcgtctcgtcgtctcctccgctcctcctctccttgcgccaacaagccgactcgcgatctccatcgggcaagaagagcagagcagagcaggggaggggatcctgcagtttaggcgcacgcatcgcccatggccaccttcgagctctaccggaggtccaccattggcatgtgcctcactgagacgctcgacgagatggtctccagcggcaccctcagcccggagctcgccattcaagttcttgtccagtttgataagtctatgacggaagccttggagaaccaagtcaagagcaaggtttctatcaagggccacctgcacacttacaggttctgtgacaatgtatggacattcatcttgactgaagcatcattcaagaacgaggagactacagaacaagttggcaaggtgaagattgtggcctgtgattccaaactactcagccaataaattgataactgcgaggtcagggtttgcctggtatttgttagtctcttctgctagacctggctccgcctgaagtgtactgtaccaccacattgtttgtttcataatcaatgtgtgtcaatacaatcgtatgtgctaccagagtatatcacagcagcaactgttttaatttgtatgcttatgtaattgttatgctactgctgtgttgataatgtgatataaatgactaaacgatgagtagtagaaattgtgcggagtcaccctcccccttcctcatttctgaaccctttggttctgtgtgactctttgtatgtaacatgaacaaatacctcctttcccgtcttttttttggatcctatgttaatggtacctttacattaaaaaaaaaaaaaaaaaaaa

SEQ ID NO: 310 - protein, 106 aa, Oryza sativa
MATFELYRRSTIGMCLTETLDEMVSSGTLSPELAIQVLVQFDKSMTEALENQVKSKVSIKGHLHTYRFCDNVWTFILTEASFKNEETTEQVGKVKIVACDSKLLSQ

SEQ ID NO: 311 - DNA, 547 bp, Glycine max
  unsure (454): n is a, c, g or t
  unsure (473): n is a, c, g or t
  unsure (493): n is a, c, g or t
  unsure (497): n is a, c, g or t
  unsure (521): n is a, c, g or t
  unsure (524): n is a, c, g or t
  unsure (532)..(533): n is a, c, g or t
  unsure (546): n is a, c, g or t
atttctccaacgctatcgaaccaaacccaaacgttaactcagaagaagaccagcagaagaagaagaagaagaaacaaaaccgaaccactttcaactctccaacgtcgccacacgattcatcgcgtttcgcaggctgcaatggcgacgttcgaactgtaccgcagtcgaacgatcggaatgtgcctgacggagacgctggacgagatggttcagaacggcactctcagccccgagctcgcgattcaggttctggtccagttcgataagtccatgactgaggctctggaaacacaagttaagagcaaggtctccatcaagggacatctccatacatatagattttgcgacaatgtttggaccttcatcttgcaagatgctttgttcaagaacgaagacagccaaaagaatgttggacgggttaaaatagtggcgtgtgatcgaagtgctaaacaanatggcccaatctgcacctntaacaggagattgtgaactntggncaatgaaatgtggcagccatagtncanggctaaannatgcggactgacnc

SEQ ID NO: 312 - protein, 100 aa, Glycine max
MATFELYRSRTIGMCLTETLDEMVQNGTLSPELAIQVLVQFDKSMTEALETQVKSKVSIKGHLHTYRFCDNVWTFILQDALFKNEDSQKNVGRVKIVACD

SEQ ID NO: 313 - DNA, 729 bp, Glycine max
gcacgagcaaatttctccaacgctatcgagccaaacccaaacgttaactcagacgaagcaccaacagaagaagaagaaacaaaaccgaacctctctaaactctccaacgtcgccacccgattcatcgcatttcgcaggctgcaatggcgacgttcgaactgtaccgcaggtcgacgattggaatgtgcctgacggagacgctggacgagatggttcagaacggcactctaagccccgagctcgcgattcaggttctggtccagttcgataagtccatgactgaggctctggaaacgcaagttaagagtaaggtctccatcaagggacatctccatacatatagattttgtgacaatgtttggaccttcatcttacaagatgctttgttcaagagcgaagacagccaagagattgttggacgggttaaaatagtggcgtgtgactcgaagttgctcacacaataatgtgcctaatttctgccattgtcgacaaggacaaattgttgtcatctgctggtactatgggaatggtggccagaccatagttaaaatggtcttaaattcttgcaggaactagcaactattgtatgttattattatagatttaaaagccatcagtcttcatatcattaggtaattaatgctacaatgagaataccgcttggaaattgaatgaatctactcccttcttttaaaaaaaaaaaaaaaaaaaaaaaaaaaaaaaaaaaaa

SEQ ID NO: 314 - protein, 106 aa, Glycine max
MATFELYRRSTIGMCLTETLDEMVQNGTLSPELAIQVLVQFDKSMTEALETQVKSKVSIKGHLHTYRFCDNVWTFILQDALFKSEDSQEIVGRVKIVACDSKLLTQ

SEQ ID NO: 315 - DNA, 779 bp, Triticum aestivum
gcacgagcccactcctctcccccgatccgaaccctctcctcgccgcgctccgccccgcagcgccccggatctcgccgccaggaccgccgtcgacccgcagccgccgcaggcaaggcgatatggccaccttcgagctgtacaggcggtccaccatcggcatgtgcctcaccgagacgctcgacgagatggtctccagcggcaccctcagccccgagctcgccatccaagtgctagtccagttcgataagtctatgacggaggcactggaaaaccaagtgaagagcaaggttactgtcaagggccatctgcacacctacaggttctgcgacaacgtgtggacattcatattaaccgacgcgcagttcaagaatgaggagacgaccgagcaggtgggcaaggtgaagatcgtggcctgcgactccaagctactcagccaataagcagctctcgcgcgagctgccgactcccggaggcgggggtgggctcgttcgatcgatccccgcctccgctagagaagaacaccaccaccatcaccaccgccacatccccccctcctcataatccatgggtacctgtagaagaaggatctcatgcgatgcgatcctagagcagagcagagcagagcgtcgcatcgcggccacataacttttctccggtccgtgccgtgtactgttgtttccggaacttttggtataactggcgactggaatgagcaagtagcaaacaaaaactttgcttggaaaatctgtgtgacatttagtaaaaaaaaaaaaaaaaaa

SEQ ID NO: 316 - protein, 106 aa, Triticum aestivum
MATFELYRRSTIGMCLTETLDEMVSSGTLSPELAIQVLVQFDKSMTDALETQVKSKVTVKGHLHTYRFCDNVWTFILTDAQFKNEETTEQVGKVKIVACDSKLLSQ

SEQ ID NO: 317 - DNA, 1621 bp, Hordeum vulgare
gcacgagggaatactatcctcatggttatcatggcgttgacaaagaggggagacctgtttatatcgaaaggcttggaaaggttgaccctaacaagcttatgaatgtaacaactatggacagatatgtaaggtaccatgtgaaggaattcgagaggagcttcttgatcaaatttccagcatgctctcttgcggctaaaagacacatcaattcgagcacaactattctggatgttcagggtgtgggtttgaaaaatttcagcaaaactgcacgtgaattaattatgcgactgcagaaagttgacaacgataactaccctgagactttacaccaaatgtttatagtcaatgctggccctggctttcggatgctatggagcactgtgaaatctttcctcgacccaaaaaccacttccaagatacatgtacttgggaacaagtgtcagagtaaactgcttgaaataattgatgctagtgaattgccagaatttcttggtggcaattgtacctgtcccgaatatggagggtgcctcaaagctgaaaagggcccatggaaggacgcgaacatactgaagaaagtccttaatggtgaggcccagtgtgctcggcagattgtaactgtttccaatgggatggaaactattatttcttatgccaagtctaagcaccaaacggtacgtggaagtgatacatcaactgcggagtctggatctgaagctgaagatgtaacttcccccaaggctctaagaagttacatctcccatcctaagttgaccccagttcgtgaagaggtcaagatgatcagggccactagcttttctacccgcatgcctgaatatgatattcctgttgttgacaaagcagtggatgcaacatggaagagagaactgccccggaaggcacccttcccgtccaaagactcttcttctttggctgccaccacaaaggcacccaacaggtcgctggatcaggttattccagctctgatggcttttgtgattgctattgtaacgctgctccggtcagttaagatgttgccacaaagagattgccacataaaaatgagtcagatgaacaaagttcttcaatatatcaagactgcattcccaaggaggagttccgccccccgtcgccaggtcctgggtttgctgaatctgacctgttctcgttagtcttgcaaaggctggcagagcttgaagccaaggttcacgcgcttgaagaaaaaccttccgaaatgccttgcgagaaagaagagttgcttaatgctgctgtccgccgtgtggatgcactggaagctgagctcattgtaacaaagaaggctctgcacgaggctcttatcaggcaagaggaactacttgcttacgttgacaggaagacaattgccaaggcccagaaaaagaagaagaagccaatgtcttgctactaggacaaggagagagactcccttggttcagttttcctttttctgagatgccggagatggcgtttgagatgatgtaaacggttggttgatccgttcgttttcctgacaaatgtgaaaaagacatacatgggtttgtaaatggacagaaaatcctgacataaataaatgtgtttttgggccgaaaaaaaaaaaaaaaaaaaa

SEQ ID NO: 318 - protein, 473 aa, Hordeum vulgare
TREYYPHGYHGVDKEGRPVYIERLGKVDPNKLMNVTTMDRYVRYHVKEFERSFLIKFPACSLAAKRHINSSTTILDVQGVGLKNFSKTARELIMRLQKVDNDNYPETLHQMFIVNAGPGFRMLWSTVKSFLDPKTTSKIHVLGNKCQSKLLEIIDASELPEFLGGNCTCPEYGGCLKAEKGPWKDANILKKVLNGEAQCARQIVTVSNGMETIISYAKSKHQTVRGSDTSTAESGSEAEDVTSPKALRSYISHPKLTPVREEVKMIRATSFSTRMPEYDIPVVDKAVDATWKRELPRKAPFPSKDSSSLAATTKAPNRSLDQVIPALMAFVIAIVTLLRSVKDVATKRLPHKNESDEQSSSIYQDCIPKEEFRPPSPGPGFAESDLFSLVLQRLAELEAKVHALEEKPSEMPCEKEELLNAAVRRVDALEAELIVTKKALHEALIRQEELLAYVDRKTIAKAQKKKKKPMSCY

SEQ ID NO: 319 - DNA, 2244 bp, Zea mays
  unsure (6): n is a, c, g or t
  unsure (383): n is a, c, g or t
  unsure (638): n is a, c, g or t
  unsure (650): n is a, c, g or t
  unsure (659): n is a, c, g or t
  unsure (674): n is a, c, g or t
  unsure (677): n is a, c, g or t
  unsure (681): n is a, c, g or t
  unsure (683): n is a, c, g or t
gccganttccaaattgaaacagttgcaggcgattctgagctcgggttttgttccggggacggattcctgtgccggcggacgggatgtcaggccctctcgaccgatttgctaggccatgctttgaagggtttgtacataacgatgaaaggaaagagagcagatctgatgcagacaactcagaaggagataagaagactaagattgggtctttcaagaaaaaagcaattaatgcggggaacaaattcaggcattccttgagaaggagaagcaaaaaaaagaccgaaaggggggattccatcaaggacataagggacgttaaagagcttcaagatgttgagacattccgacaatgcttaattgatgaggatttgctgccaccacancacgattattatcacatgatgttaaggttcctaaaagcacggaaatttgaagttgagaaagctaagagtatgtggtcagacatgatcaattggaggaaggaattcggagtcgacaaaatagaggaatttgactacaccgagttagatgaagtgacagagtattacccacaattttatcatggagtagataaagagggaagacctgtctacatagaattagtaggaaaagttgatgcaaacaagctaatacaagtnacaaccctagancggtatgtnaaataccatgtcaangantttnanaagtgcttccagatgaaatttccagcttgcaccattgctgctaaaaaccacatagattcgtccactactattttggatgtgcaaggcgtgggtttcaagaacttctcgaaatctgccagagaattaatcacacgattacagaagatcgacagtgataactacccagagacactgtgccggatgtatataattaatgctggccaaggcttcaagatgttatggagcacaataaaatcattcctcgatccaaaaactgcttccaagatccatgttcttgggaataagtatcaacataagttgctcgaaataattgacgagtgtgaactgccagaatttcttggtggcaaatgcaattgtattgaaggttgccaaagatctgacaaaggtccttggaaggatcccaacataataaagagagtcctcaatgacgaggcaaactacggcagacaaattgtgaccatatccagcattgatggaaaaataatacgttatgctaggccagatcacccaactagaaaagggagtgatgcatctgccgagtctggatctgaagtggaagatgtaacatctcctactgcatcaaggaacctgattacacatcctattttgacccctgttcacgaagagtcaaaattgtcgccacatggttccacatttgttgctcatgcttctattgaagaaaacattcctgttgtagacaaggttgtggatgatggatggggtactcccagaggtagtctccaagcttcttcaggttcgttgccctcgagaaacacgcacggcacattcgaaggactgagagttcaagctgtcgcatggctgacgttcttgatcacggcccttttcgccacgctctgttccgtcccgagcaagatggccagaaggatctccagccagtctagcaagcacgacgactaccgcggcgagtatcctcaagaggaggaggagcacaaggaggagttccggcctccgtctcctgccccgtcctacacggagaaggacgtgctctcgtcgatgctgagacggctcggtgagctggagggcagggtgcaggtgctcgagacgaagccgtccgagatgccgtttgagaaggaggagctgctcaacgcagccgtccgccgcgtggacgcgctggaagccgagctgatctccacgaagaaggccctctacgatgctctgatgcgacaggatgagctgctcgcgtacattgacaggcaggagctgatcaagttccgtaaaaagaagttctgcttctaagatctgaccatggagcagctggtcatgtccggagccgttcgtgtatattgttggatcgcggctagtacggtgaatgatgtaatgtgtccatctgtacaagtgtgtaacggaacggtgtaagtatagtaggaaaacaatgtgttagctgtgcggtagcacttgtgtgctagcctaaattgtaatcttgcaagtcggtgcatagctgattgcgcaccaatacgtagttatgaatggaatcgcactcgtgttcgtataaaataaaataaattagcagcgccaaatgtttaaaaaaaaaaaaaaaaaa

SEQ ID NO: 320 - protein, 618 aa, Zea mays
  UNSURE (189): Xaa can be any naturally occurring amino acid
  UNSURE (200): Xaa can be any naturally occurring amino acid
MSGPLDRFARPCFEGFVHNDERKESRSDADNSEGDKKTKIGSFKKKAINAGNKFRHSLRRRSKKKTERGDSIKDIRDVKELQDVETFRQCLIDEDLLPPQHDYYHMMLRFLKARKFEVEKAKSMWSDMINWRKEFGVDKIEEFDYTELDEVTEYYPQFYHGVDKEGRPVYIELVGKVDANKLIQVTTLXRYVKYHVKEFXKCFQMKFPACTIAAKNHIDSSTTILDVQGVGFKNFSKSARELITRLQKIDSDNYPETLCRMYIINAGQGFKMLWSTIKSFLDPKTASKIHVLGNKYQHKLLEIIDECELPEFLGGKCNCIEGCQRSDKGPWKDPNIIKRVLNDEANYGRQIVTISSIDGKIIRYARPDHPTRKGSDASAESGSEVEDVTSPTASRNLITHPILTPVHEESKLSPHGSTFVAHASIEENIPVVDKVVDDGWGTPRGSLQASSGSLPSRNTHGTFEGLRVQAVAWLTFLITALFATLCSVPSKMARRISSQSSKHDDYRGEYPQEEEEHKEEFRPPSPAPSYTEKDVLSSMLRRLGELEGRVQVLETKPSEMPFEKEELLNAAVRRVDALEAELISTKKALYDALMRQDELLAYIDRQELIKFRKKKFCF

SEQ ID NO: 321 - DNA, 814 bp, Zea mays
  unsure (49): n is a, c, g or t
  unsure (52): n is a, c, g or t
  unsure (61): n is a, c, g or t
  unsure (789): n is a, c, g or t
  unsure (792): n is a, c, g or t
gcgcctctcaccatttgggcccccgcgcactccgccccgcgacgagcgngcnaccaccccngcctctatttctttagcatcgccgcccccaagccatttctctccagcatcgccgccccccctctccgcctcaaggctctcctctcggaggtctgataggcaacccaataatggcagaagtcctatcaggatctcatgaacaccgtctaagcactgccttagatggacactacgacgagaagaggaaatccaatgtggaatacacagaggacgagaagaaagccgtgatcgcggctctgaaaaagaaggctttgagcgcctcacagaagtttaggcattccatgaagagggggaggaagagcagcaaggtgatgtccatctcgattctggataagcgtgaacctgaggaggtgcaggctgtggatgccttccgccagcttcttgtacttgaagagctgctaccatcgcagcatgatgactaccacatgatgctaagatttctcaaggcaagaaagtttgatatcgagaaggcaaagcaaatgtggtctgatatgctgaagtggagaaaggagttcggtgcagataccattctcgaggaattcgaattcgaagaagctgataaggtggcagaatgctaccctcaaggttaccatggggttgataaggaaggcaggcctgtctactttgaacggcttggacagatcgatgtgaataggctaatgcagtcactacatgatcgctttgtcaagaaccatgtcaaggagttcgagaagaactttgctggtaaanttnccagcttgctcatcgccgcgaa

SEQ ID NO: 322 - protein, 214 aa, Zea mays
  UNSURE (207)..(208): Xaa can be any naturally occurring amino acid
MAEVLSGSHEHRLSTALDGHYDEKRKSNVEYTEDEKKAVIAALKKKALSASQKFRHSMKRGRKSSKVMSISILDKREPEEVQAVDAFRQLLVLEELLPSQHDDYHMMLRFLKARKFDIEKAKQMWSDMLKWRKEFGADTILEEFEFEEADKVAECYPQGYHGVDKEGRPVYFERLGQIDVNRLMQSLHDRFVKNHVKEFEKNFAGKXXSLLIAA

SEQ ID NO: 323 - DNA, 1762 bp, Zea mays
cggagaggcagtgccgagcaggtagggagagaaacagagcgagagaatacccgacctctcgcctccgccctagctaccaaggttcctcctgatcgatcgattcccttccatccaaacccccaacaaaatacgacagtggcggcggtcgaggttcggtgcgagagcgcgacgttccggaatcggcggcggcgaagatgtcggtgagccacgcggaggacatcgagatatcgctgtgtgacggcaactcggaggacgagcggcggcggcgtaagatcggctcgctgcggcggaaggctatccacgcgctcaagaagcgagggaggcgccgcgtcgacttccgcttcccgccggcggccatctccatcgaggacgtccgcgacgccgaggaggagcgcgccgtcgcctccttccgggaccgcctcgccgcgcaccgcctcctccccgacaagcacgacgactaccacatgatgctcaggttcctcaaggccaggaagtttgaagccgataaggcaatgcagatgtggtcggagatgctgaaatggaggaaggagttcggaactgacaccatcctcgaggattttgatttcgcagaactggatgatgtgctgcgctactaccctcagggctaccatggtgtggaccgcgaaggccggcccgtgtacattgagaggctagggaaggtggatcccaacaaactcatgcagatcacgtctgtggatcgctacatcaagtaccatgtccaggagtttgagagagccttcagggagaggttccctgcctgcacattggctgccaagaggcacattgactcgaccactaccatcttggacgtccagggtgtggggtttaagaatttctccaggactgctagagaacttgtaaaccgaatgcagaagattgatagcgattattatcctgagacactccaccaaatgtttgttgtgaacgctggcagtggattcaagtggatctggaacagtgtgaagggcttccttgacccaaaaacttcatccaagattcatgtgctcggttcgaactaccagagtaggcttcttgaagtaatagattcgagtgagttgccagaattccttggtggttcatgcacatgtagtgacaagggtggttgccttggatcgaacaaagggccatggaatgatccttatatattgaagctgatccacaatttggaagctggatgcatgagggaaaccaccaaacccgtttctgagggcggagaaagaagcagctcttcctttcggttggaacagatgaaatggcagggcatgttaagcgatacatcaaatgctgaatcaggatccgatgttgatgattttggtccatcatttgttcataaagtttcaggctatggttgcttgactccggttcgtgaggaggtaaagggcacagattgtgcaacatacttgagctgcgatgatcaaagtcacccggatatggttcctgaattttaccatggagtgcaacggactactgaaatggtgcagaaacaaatggctgatttcaggcaatattccaccaacagaaggcctcgtgaattaggtatcttattttcctatcgttccgggtaattgaattctgaacctgtagttgtttgttaacatttaataaagagtaaggccattgaagatggtgtatgattttctagtgtcatgtcgcgttgaagctctgtaaccatgaattttctgtttgtttgctactgcataaaacaccatcagccatacattccctggtaccataagacttt

SEQ ID NO: 324 - protein, 433 aa, Zea mays
MSVSHAEDIEISLCDGNSEDERRRRKIGSLRRKAIHALKKRGRRRVDFRFPPAAISIEDVRDAEEERAVASFRDRLAAHRLLPDKHDDYHMMLRFLKARKFEADKAMQMWSEMLKWRKEFGTDTILEDFDFAELDDVLRYYPQGYHGVDREGRPVYIERLGKVDPNKLMQITSVDRYIKYHVQEFERAFRERFPACTLAAKRHIDSTTTILDVQGVGFKNFSRTARELVNRMQKIDSDYYPETLHQMFVVNAGSGFKWIWNSVKGFLDPKTSSKIHVLGSNYQSRLLEVIDSSELPEFLGGSCTCSDKGGCLGSNKGPWNDPYILKLIHNLEAGCMRETTKPVSEGGERSSSSFRLEQMKWQGMLSDTSNAESGSDVDDFGPSFVHKVSGYGCLTPVREEVKGTDCATYLSCDDQSHPDMVPEFYHGVQRTTE

SEQ ID NO: 325 - DNA, 910 bp, Zea mays
gacgagctggaacaccgtcaagtcgttcctggaccccaagaccacggccaagatccatgtccttggcaacaagtaccagagcaagctcctggaagtgatcgatgccagcgagctgcccgagttcttcggcggcacttgcaactgcgagggcggctgcatgcgctccgacaaagggccatggaaggaccctgagatcctcaagatggtccaatgcggcatggggagatgcgggatgaacagcggggaccctcgcgacgccgacgagaagctcatcaccgaggacgaaatagtgcccgttcccaagaagcaagactccatgcgccgcaacgccgtggattcccccaaggtggcgcgcgagaagatcgagcacccgcagatgtccccgctccacgagatgaagaccgccagcgacccggaccctgccgccaaggacagcttcgacggcggcgggctgttccccggcgtggacaggggcatggacttcaactggagcggcgaggtgagcgaggagaagctgcagatcgcgcgggacatgtacgcgcagctgccggacgcgtacaagcagggggacgcgggagaccggcaggtggtgtcggggttcatggcgctggtgatgggcgtggtggccatgttccgggtgggcaagatcgcgccgaagcgggccatggacgcggccatgggcatcgccaccatggaggccatggccaagaagacgcggcagatgcagatgcagcagcagctgcagctgggcgggcccgacgccgtcgtggtgtcggcggcgcagtaccaggcgctggtcaagcgcgtggacgacctggaggccaaggtggcggcgctggcgtcgggcccgcccgaggtgccgcccgagctggaggagtcgatcaaggccgccgccgcccgcgtcgacgcg

SEQ ID NO: 326 - protein, 303 aa, Zea mays
TSWNTVKSFLDPKTTAKIHVLGNKYQSKLLEVIDASELPEFFGGTCNCEGGCMRSDKGPWKDPEILKMVQCGMGRCGMNSGDPRDADEKLITEDEIVPVPKKQDSMRRNAVDSPKVAREKIEHPQMSPLHEMKTASDPDPAAKDSFDGGGLFPGVDRGMDFNWSGEVSEEKLQIARDMYAQLPDAYKQGDAGDRQVVSGFMALVMGVVAMFRVGKIAPKRAMDAAMGIATMEAMAKKTRQMQMQQQLQLGGPDAVVVSAAQYQALVKRVDDLEAKVAALASGPPEVPPELEESIKAAAARVDA

SEQ ID NO: 327 - DNA, 1726 bp, Zea mays
gggggggatttctaaaagcaaggaaatttgatatcgacaaagcaaagcaaatgtggatggatatgcttcattggcggagggagtatggcactgatacgattttggaggacttcgaatacactgagttggacgctgttttgcaatattatcctcatggttatcatggagttgacaaagaggggagacccgtttatattgaaaggcttggaaaggttgaccctagcaaacttatgaatgtcacaacgatggatcgatatgtgcgataccatgtgaaggagtttgagaggagcttcttgattaaatttccagcttgctctgttgctgcaaaaacgcacattgattccagcacaacaattctggatgtccagggcgtgggtttgaaaaatttcagcaaaactgcacgtgaattaattcagcgactgcagaaaattgacaatgataactacccagagactctataccaaatgtttattgtcaatgctggtccgggtttccggctactatggaacactgtgaagtccttccttgatcccaaaacgaccgccaagatacatgttcttgggaacaaataccaaagtaagctgcttgaaacaattgacgctagtgaattgccagaattccttggtggcacttgtacctgtcctgaatacggaggttgccttaaggctgaaaagggaccgtggaaggacccaaacatacttaagatagtccaaagtggtggggttcattgtgctcgtcaaattgtaactatttccaatggtgaggaaaaatttattacttacgccaaaccgaagcgccacgcaatgagagggagtgacacatcaactgctgagtctggctcagaagctgatgatgctatctcccccaaagctctcagaagttacatgccacatcctaagttgaccccagttcgtgaagaggtcaaaattgtcagggctacgagcttttctactcgtgtccctgaatatgatgtacctgttgttgacaaggccgtggatgctacatggaagagagagcaaccacgaaagataccattcatgccccaagatgcagactcatctgtgaaaactgcatccaagccatctggccgcccctgggataagatcgctgcaactctgatggcttgtcttatggctattgtaatgttggttcgatcagtcaaagatcttgtcacaaggagattgccatataaaggcgggtcagaagaaatccactctacgctgtacccagaccccatccagaaagaggaattccgtcctccttctccgatccctggatttgctgaagccgacctgttcgccgtggtcttgcaaaggctgggagagcttgaagagaaggttcagatgcttcaagaaaagccttccgaaatgccttgcgagaaagaagagttgcttaacgccgctgtgcgtcgtgtcgatgcattggaagccgaactaattgtaacaaagaaggctttgcacgaggctcttatcaggcaagaggaactgcttgcgtacatcgaccgcaaagagattgccaaggctcagagaaagaagaaagcaatgctttgctactaggacaaggagggagatacttctgcttcctcagaggagatgccaaagatggcgcctgagatgtaaccagcgatccccttcattttcctgacacttgtgaatcttctacaagtttccgttgtaaatcgagaatattctgacatgaataaagtgttttttggcatcaatcctga

SEQ ID NO: 328 - protein, 517 aa, Zea mays
GGFLKARKFDIDKAKQMWMDMLHWRREYGTDTILEDFEYTELDAVLQYYPHGYHGVDKEGRPVYIERLGKVDPSKLMNVTTMDRYVRYHVKEFERSFLIKFPACSVAAKTHIDSSTTILDVQGVGLKNFSKTARELIQRLQKIDNDNYPETLYQMFIVNAGPGFRLLWNTVKSFLDPKTTAKIHVLGNKYQSKLLETIDASELPEFLGGTCTCPEYGGCLKAEKGPWKDPNILKIVQSGGVHCARQIVTISNGEEKFITYAKPKRHAMRGSDTSTAESGSEADDAISPKALRSYMPHPKLTPVREEVKIVRATSFSTRVPEYDVPVVDKAVDATWKREQPRKIPFMPQDADSSVKTASKPSGRPWDKIAATLMACLMAIVMLVRSVKDLVTRRLPYKGGSEEIHSTLYPDPIQKEEFRPPSPIPGFAEADLFAVVLQRLGELEEKVQMLQEKPSEMPCEKEELLNAAVRRVDALEAELIVTKKALHEALIRQEELLAYIDRKEIAKAQRKKKAMLCY

SEQ ID NO: 329 - DNA, 1068 bp, Zea mays
  unsure (1063): n is a, c, g or t
gcggacgcgtggggtaaaatgaagaatgataaccatgtagcctcaatagatgacataagagatggtcaagagctggagattgttgaaaggttccgcgagtgtttaatcgacgagggcttgttgccagaacatcatgatgattatcacatgatgttgaggttcctgaaagcaaggaaatttaatattgacaaagcaaagcagatgtggtcagagatgcttagatggaggaaggaatttggtgctgacgatataaaggaattcgactacactgaattagatgaagttgtgaagtactatccacaactttaccatggtgtggacaaaggtggaaggcctatttacatagaactaattgggaaagttgataccaacaaactagtgcaaataacaactattgaccgctatttaaaatatcatgtcaaggagttcgagagatgtctccagatgaggtttccagcttgttctattgctgcgaaaaggcacatagactcgtctactacgatattggatgtgaaaggcgtgagcctaaagaacttcacaaaagatgcaagagagctaattatgcggttgcagaatatcaacaataacaactatccagagaccttacagcaactgtgcatcataaatgctggccaaggcttcaagatgttatggggtacaataaaatcatttcttgatccagaaactgcttcaaaaattcatgtccttggaaacaagtaccaaactaaattacttgaaataattgatgacagtgaactaccagaatttcttggtggcaagtgcagatgtgaagagtatggaggttgtctgaaatcaaataaaggcccttggaaggaccctgaaattgttaagaaggttatcaatggtgaggcaaactatgttaggcaagttattgctgtatcaaacataaatcaaaaggaagttagttgtactgaacactcaactgaggaaaaagtcaacgatgcctctgtcgaatctatttctgaagtggaagatgtttcttcttcaacggctttaatggatcacatcataagccctaatttgacctttgtggatgagtcanaattt

SEQ ID NO: 330 - protein, 321 aa, Zea mays
MKNDNHVASIDDIRDGQELEIVERFRECLIDEGLLPEHHDDYHMMLRFLKARKFNIDKAKQMWSEMLRWRKEFGADDIKEFDYTELDEVVKYYPQLYHGVDKGGRPIYIELIGKVDTNKLVQITTIDRYLKYHVKEFERCLQMRFPACSIAAKRHIDSSTTILDVKGVSLKNFTKDARELIMRLQNINNNNYPETLQQLCIINAGQGFKMLWGTIKSFLDPETASKIHVLGNKYQTKLLEIIDDSELPEFLGGKCRCEEYGGCLKSNKGPWKDPEIVKKVINGEANYVRQVIAVSNINQKEVSCTEHSTEEKVNDASVESI

SEQ ID NO: 331 - DNA, 1341 bp, Oryza sativa
  unsure (1338): n is a, c, g or t
gcacgagatcactcggcagcagcaggagcttccctctctttttggtccaaaatcatcgcccaaaatccgaggttggagcttttgctcgggcgattgattttggaatcggaggaggggatgtcaggaccactcgatcgatttgccaggccatgttttgaaggttttacgcataatgatgaaaagaaagagatcagatctgacgcagacaactccgaaggagagaagaagactaaaattggttctttcaagaaaaaggcgattaatgccgggaacaaattcaggcattccctgaggagaagaagcaaaaagaaaaatgaacctcggggttccattgaggacataagggatgttcaagatcttcaagctgttgatgcatttcgacaatgtttagttgatgaggacctgttgccgcaacagcatgatgattatcacacaatgcttaggttcctcaaagcacggaaatttgatgttgagaaagcaaagagtatgtggtcagatatgcttaaatggagaaaggaatttggggctgacaatatagaggagtttgactacaccgaggcggatgaggttatgaaatattatccacaattttaccatggagtggataaagaaggaaggcctatctacatagagttaataggaaaagttgatgcgaataagctaatgcaagtaactactatagagcgatatgtgaaatatcatgtgaaggagtttgagagatgcttccaaatgagatttcctgcctgctcgattgctgcaaaaaggcccatagattcatctactactattctggacgtgcaaggcgtgggtttaaagaacttctcaaaagctgcaagggatctaatcacacgactgcagaagatcgacaatgacaactacccagagacgttgcgccgcatgtatattattaatgccggccaaggcttcaagatgttatggagcactgtaaaatctttcctagatcctaaaactgcttcaaagattcatgttctaggaagcaagtaccaaaataagttacttgaaataattgatgagaatgaattgccagagttttttggtggaaaatgcaagtgcgaggcatttggaggttgcaaaaaatcagataaaggtccttggaaggatcctaacataataaagagggtcctgaatggcgaagcaaattatgggaggcaaattgtgaccatatcaagcactgatggaaaaataattcgttatgctgggccacaatacccaacaagaaaaggaagtgatggctcagcggagtctgggtctgaagtggaagatggcgcgtcacctatggcatcaaggaacgtcttcaccgattggcgcagaagcttngaa

SEQ ID NO: 332 - protein, 406 aa, Oryza sativa
MSGPLDRFARPCFEGFTHNDEKKEIRSDADNSEGEKKTKIGSFKKKAINAGNKFRHSLRRRSKKKNEPRGSIEDIRDVQDLQAVDAFRQCLVDEDLLPQQHDDYHTMLRFLKARKFDVEKAKSMWSDMLKWRKEFGADNIEEFDYTEADEVMKYYPQFYHGVDKEGRPIYIELIGKVDANKLMQVTTIERYVKYHVKEFERCFQMRFPACSIAAKRPIDSSTTILDVQGVGLKNFSKAARDLITRLQKIDNDNYPETLRRMYIINAGQGFKMLWSTVKSFLDPKTASKIHVLGSKYQNKLLEIIDENELPEFFGGKCKCEAFGGCKKSDKGPWKDPNIIKRVLNGEANYGRQIVTISSTDGKIIRYAGPQYPTRKGSDGSAESGSEVEDGASPMASRNVFTDWRRS

SEQ ID NO: 333 - DNA, 2334 bp, Oryza sativa
gcacgagatcactcggcagcagcaggagcttccctctctttttggtccaaaatcatcgcccaaaatccgaggttggagcttttgctcgggcgattgattttggaatcggaggaggggatgtcaggaccactcgatcgatttgccaggccatgttttgaaggttttacgcataatgatgaaaagaaagagatcagatctgacgcagacaactccgaaggagagaagaagactaaaattggttctttcaagaaaaaggcgattaatgccgggaacaaattcaggcattccctgaggagaagaagcaaaaagaaaaatgaacctcggggttccattgaggacataagggatgttcaagatcttcaagctgttgatgcatttcgacaatgtttagttgatgaggacctgttgccgcaacagcatgatgattatcacacaatgcttaggttcctcaaagcacggaaatttgatgttgagaaagcaaagagtatgtggtcagatatgcttaaatggagaaaggaatttggggctgacaatatagaggagtttgactacaccgaggcggatgaggttatgaaatattatccacaattttaccatggagtggataaagaaggaaggcctatctacatagagttaataggaaaagttgatgcgaataagctaatgcaagtaactactatagagcgatatgtgaaatatcatgtgaaggagtttgagagatgcttccaaatgagatttcctgcctgctcgattgctgcaaaaaggcccatagattcatctactactattctggacgtgcaaggcgtgggtttaaagaacttctcaaaagctgcaagggatctaatcacacgactgcagaagatcgacaatgacaactacccagagacgttgcgccgcatgtatattattaatgccggccaaggcttcaagatgttatggagcactgtaaaatctttcctagatcctaaaactgcttcaaagattcatgttctaggaagcaagtaccaaaataagttacttgaaataattgatgagaatgaattgccagagttttttggtggaaaatgcaagtgcgaggcatttggaggttgcaaaaaatcagataaaggtccttggaaggatcctaacataataaagagggtcctgaatggcgaagcaaattatgggaggcaaattgtgaccatatcaagcactgatggaaaaataattcgttatgctgggccacaatacccaacaagaaaaggaagtgatggctcagcggagtctgggtctgaagtggaagatggcgcgtcacctatggcatcaaggaacctgataacaaatccccttttgacccctgttcatgaggagtcaaaattggcagcacatggatttacatctgcttccccttccattattgaagaaagcattcctgttgttgacaaggttgtggatgatggatggggcagtcctagagctagttcatcaccctcgagaagtttgcctatcacatttgatggcctctggacacaagttatcacatggctgactgtcttgatcgtgagcctttttgctatggttcgctctgtcccaagcaggatggctaaaagattctcaagccaatccactgaccatgatcactcctatgtggagtatcctcaagaagcagagtacaaggaagaattccggccaccgtctcctgctccgtcttatactgaaaaggatgtcctctcatctatggtaagacgactaggcgagttggaggagaaggtgcaggcgctcgaaacgaagccatccgagatgccatttgaaaaggaggaattgctgaatgcagccgtccgccgtgtggatgcattagaagccgagttaatctctacaaagaaggctctctatgaagccctgatgcggcaggacgagctgcttgcgtacattgacaagcaagatatgatcaagtttcgtaaaaagaaattctgcttctagcagctcaacgacgagttaattctccatacacagagctgttcgtgtatatttggatcaattaatcaccacgaatatgaatgaatgcagctagtttggagtgtaaaattaaaagtgtgcatatggcaaattgagaatccaacaataacaccacggtatcggtatgtgagttacaaggtggaccttgaggtgttgttggctggtcattcagaatccagacgatgcatcgtcttgtgctggagggtcctggctgctgtaaattaagcctgtaattaatcttgtgacttgtaacatatatagcacaaatgtgagttaaaatcgttgtaaatggacttcaccttgaaaaaaaaaaaaaaaaaaaaaaaaaaaaaaaaaaaa

SEQ ID NO: 334 - protein, 613 aa, Oryza sativa
MSGPLDRFARPCFEGFTHNDEKKEIRSDADNSEGEKKTKIGSFKKKAINAGNKFRHSLRRRSKKKNEPRGSIEDIRDVQDLQAVDAFRQCLVDEDLLPQQHDDYHTMLRFLKARKFDVEKAKSMWSDMLKWRKEFGADNIEEFDYTEADEVMKYYPQFYHGVDKEGRPIYIELIGKVDANKLMQVTTIERYVKYHVKEFERCFQMRFPACSIAAKRPIDSSTTILDVQGVGLKNFSKAARDLITRLQKIDNDNYPETLRRMYIINAGQGFKMLWSTVKSFLDPKTASKIHVLGSKYQNKLLEIIDENELPEFFGGKCKCEAFGGCKKSDKGPWKDPNIIKRVLNGEANYGRQIVTISSTDGKIIRYAGPQYPTRKGSDGSAESGSEVEDGASPMASRNLITNPLLTPVHEESKLAAHGFTSASPSIIEESIPVVDKVVDDGWGSPRASSSPSRSLPITFDGLWTQVITWLTVLIVSLFAMVRSVPSRMAKRFSSQSTDHDHSYVEYPQEAEYKEEFRPPSPAPSYTEKDVLSSMVRRLGELEEKVQALETKPSEMPFEKEELLNAAVRRVDALEAELISTKKALYEALMRQDELLAYIDKQDMIKFRKKKFCF

SEQ ID NO: 335 - DNA, 574 bp, Glycine max
  unsure (495): n is a, c, g or t
  unsure (511): n is a, c, g or t
  unsure (528): n is a, c, g or t
  unsure (538): n is a, c, g or t
atgtagcttcgctctcacattgacccttgaaaccacaatgtccggcccgctcgaccgcttcgctagaccctgtttcgaaggattctccgggagtgatgagaagaaggaaaggagatctgattttgagaactccgaagatgaaagaagaacgagaattggatctctgaagaagaaagcgcttaacgcgtcctccaagttcaagcattcgctcaagaaaaagagcagcagaaggaaaagcgatggccgtgttagctctgtttcgatcgaagatgttcggaacttcgaggagcagcaggccgttgatgcatttcgccaagccttgatcatggaagaattgcttcctgaaaaacacgatgattaccacgtcatgttaaggttcctgaaagcaaggaagtttgatattgaaagggcaaagcatatgtgggctgatatgctacaatggaggaaagagtttgggtaccggcactattatggacggattttgagttcaaagangtaagatgcacttgtnaacgtattattcccaanggccaatcanggtggttggactacgggagcgggaggcctttctact

SEQ ID NO: 336 - protein, 140 aa, Glycine max
MSGPLDRFARPCFEGFSGSDEKKERRSDFENSEDERRTRIGSLKKKALNASSKFKHSLKKKSSRRKSDGRVSSVSIEDVRNFEEQQAVDAFRQALIMEELLPEKHDDYHVMLRFLKARKFDIERAKHMWADMLQWRKEFG

SEQ ID NO: 337 - DNA, 982 bp, Glycine max
  unsure (715): n is a, c, g or t
  unsure (916): n is a, c, g or t
  unsure (948): n is a, c, g or t
gcacgaggtttgtctcgcaattgatcatcgcaaccacaatgtccggtcccctcgatcgttttgccagaccttgctttgaggggttttcgggcagtgacgagaagaaggagaggagatctgacttcgagaactccgaggatgaaaggaggaccagaattggatctctcaaaaagaaggcacttaatgcatcctccaaattcaaacacactcttagaaagaagagtagcaggaggaaaagcgatggccgtgttagctccgtttcaattgaggacgttcgcgatttcgaggagctccaggctgtcgacgcctttcgccaatccttgatcatggacgaattgctccccgaagcctttgatgattaccatatgatgttaagatttttgaaagcgaggaagtttgatattgaaaaggcaaagcatatgtggactgacatgctacaatggaggaaggagtttggtgctgatactattatgcaggattttgagttcaaggagttagatgaagtcgtgaagtattatccacatgggcatcatggcatcgacaaggagggaaggcctgtttatattgaaagacttggaaaggtcgatccaaacaaacttatgcaagttacaactttggataggtatgtgaagtaccatgtgcaggagtttgagaaagcttttgcaatcaagtttcctgcttgctctattgctgccaagaggcacattgattccangcaccacaatcttagatgttcacggagtgggccttaagaactttacaaagtctgcccgggaactcattacccgattgcaagaagattgatggtgacaattaccctgagactctttgccaaatgtttattataaatgctgggcctggatttaagctgttgtggagcactgtcaagtcttttctcgattccaaaacaacttcnaagattcaagttcctgggaacaagtatcaaancaaattgctgaagttataaatccaagtgagtttg

SEQ ID NO: 338 - protein, 308 aa, Glycine max
  UNSURE (303): Xaa can be any naturally occurring amino acid
MSGPLDRFARPCFEGFSGSDEKKERRSDFENSEDERRTRIGSLKKKALNASSKFKHTLRKKSSRRKSDGRVSSVSIEDVRDFEELQAVDAFRQSLIMDELLPEAFDDYHMMLRFLKARKFDIEKAKHMWTDMLQWRKEFGADTIMQDFEFKELDEVVKYYPHGHHGIDKEGRPVYIERLGKVDPNKLMQVTTLDRYVKYHVQEFEKAFAIKFPACSIAAKRHIDSSTTILDVHGVGLKNFTKSARELITRLQKIDGDNYPETLCQMFIINAGPGFKLLWSTVKSFLDSKTTSKIQVPGNKYQXKLLKL

SEQ ID NO: 339 - DNA, 2206 bp, Glycine max
gcacgaggtttgtctcgcaattgatcatcgcaaccacaatgtccggtcccctcgatcgttttgccagaccttgctttgaggggttttcgggcagtgacgagaagaaggagaggagatctgacttcgagaactccgaggatgaaaggaggaccagaattggatctctcaaaaagaaggcacttaatgcatcctccaaattcaaacacactcttagaaagaagagtagcaggaggaaaagcgatggccgtgttagctccgtttcaattgaggacgttcgcgatttcgaggagctccaggctgtcgacgcctttcgccaatccttgatcatggacgaattgctccccgaagcctttgatgattaccatatgatgttaagatttttgaaagcgaggaagtttgatattgaaaaggcaaagcatatgtggactgacatgctacaatggaggaaggagtttggtgctgatactattgtgcaggattttgagttcaaggagttagatgaagtcgtgaagtattatccacatggccatcatggcgtcgacaaggagggaaggcctgtttatattgaaagacttggaaaggtcgatcctaacaaacttatgcaagttacaactttggatagatatgtgaagtaccatgtgcaggagtttgagaaagcttttgcaatcaagtttcctgcttgctctattgctgccaagaggcacattgattccagcaccacaatcttagatgttcacggagtgggccttaagaactttacaaagtctgcccgggaacttattacccgattgcagaagattgatggtgataattaccctgagactctttgccaaatgtttattataaatgctgggcctggatttaggctgttgtggaacactgtcaagtcttttctcgatcccaaaacaacttctaagattcatgttcttggaaacaagtatcaaagcaaattgcttgaagttatagatgccagtgagttgccagaatttctgggaggtacctgcacttgtgaagatcagggaggttgccttagatctgataaaggcccctggaaaaaccctgatatattcaagatggttctcactggtggagcatggcggtcaaaacaagttgtaaaagttcttaacaatgaaagaaaggttattgtgtatgccaagccaggatacccgatggtaaaaggcagtgatacatccactgctgaatcagggtcagaagccgaagatatatcctctccaaaagcgatgaagagttattcacaccttacgttgacccctgttcatgaggaagctaagatagtaggaaaaacaagctatgccagcaacttgtctgggtatgatgaatatgttccaatggtagacatacctgttgatgctggttggaagaagcaagcatctctacagaggtcttacacctctaaaggagcacctcctcctgacactcagaaaactcctgaagggattcaagctcggatgtgggtagcactgtctatcttcttcttgactgtattaactctcttacgccaagttgcataccctgtgaccaagaaatttccagcattatcttccaatgatgataagagtacttcaaaaccacctcctgatacaacaaacatggaagttcttcctccttcatcaactccatcatgtacagaggaaaatctccttccctccatgctgaaaaggttaggtgagcttgaagagaaggttgacacactccaatctaagccatctgagatgccttatgagaaagaggaattgttgaatgctgctgtatgccgggtggatgctttggaagctgagttaattgctactaaaaaggctctatatgatgcattaatgaggcaagaagagctgcttgcttacattgacagacaagaagaagccaagttgcggaaaaagaagttttgctggtgagatttatgaatgggaaagagattctgcagaggatgtctcaaagtgcaggttgttcttaaggaatgttaaccttgcgcatgatgtaactctgaccactgattttcagtatacgagtaaacataatggagaattgtttcaacgtgtgtatattcagaatgctatctttgctggcttgtaaaacacgagcctttttgcttttgttatggtcataccttcatctatccttgttacaatttgtttgcctttgttagtcgaaaagctttttcccctcctaaaaaaaaaaaaaaaaaaaa

SEQ ID NO: 340 - protein, 624 aa, Glycine max
MSGPLDRFARPCFEGFSGSDEKKERRSDFENSEDERRTRIGSLKKKALNASSKFKHTLRKKSSRRKSDGRVSSVSIEDVRDFEELQAVDAFRQSLIMDELLPEAFDDYHMMLRFLKARKFDIEKAKHMWTDMLQWRKEFGADTIVQDFEFKELDEVVKYYPHGHHGVDKEGRPVYIERLGKVDPNKLMQVTTLDRYVKYHVQEFEKAFAIKFPACSIAAKRHIDSSTTILDVHGVGLKNFTKSARELITRLQKIDGDNYPETLCQMFIINAGPGFRLLWNTVKSFLDPKTTSKIHVLGNKYQSKLLEVIDASELPEFLGGTCTCEDQGGCLRSDKGPWKNPDIFKMVLTGGAWRSKQVVKVLNNERKVIVYAKPGYPMVKGSDTSTAESGSEAEDISSPKAMKSYSHLTLTPVHEEAKIVGKTSYASNLSGYDEYVPMVDIPVDAGWKKQASLQRSYTSKGAPPPDTQKTPEGIQARMWVALSIFFLTVLTLLRQVAYPVTKKFPALSSNDDKSTSKPPPDTTNMEVLPPSSTPSCTEENLLPSMLKRLGELEEKVDTLQSKPSEMPYEKEELLNAAVCRVDALEAELIATKKALYDALMRQEELLAYIDRQEEAKLRKKKFCW

SEQ ID NO: 341 - DNA, 563 bp, Glycine max
  unsure (104): n is a, c, g or t
  unsure (492): n is a, c, g or t
  unsure (500): n is a, c, g or t
  unsure (531): n is a, c, g or t
  unsure (544): n is a, c, g or t
  unsure (549): n is a, c, g or t
caacaatggaacgctatctcaagtaccatgtaaaagagtttgaaaggaccttcgctgttaagttgcctgcatgttctatcgcggcaaagaagcacattgaccanagcacaactattttggatgttcaaggagtgggtcttaaaagtttgaacaaagctgcaagggatctcctccagaggcttcagaaaattgacggtgacaactaccctgagtcactgaaccgtatgttcatcatcaatgctggttctggatttaggctcttgtggaacaccattaagtcattcctagatcccaagaccacctcaaaaaccatgtcctaggtaacaaataccagagcaattgcttgaaatcattgatgccagtgaactccagattcttgggtggtacttgtacttgtgcagataaagtggtgtatgcttctgacaagggccatggatgaccagatacttgaagatggtcacaatggcaaggaaatcaagagaaaacttatcnggatgagngaaaagacatagaagaggacgcaatcaaacnggaacaagatcantcagnagatcaagttgttt

SEQ ID NO: 342 - protein, 159 aa, Glycine max
ARATMERYLKYHVKEFERTFAVKLPACSIAAKKHIDQSTTILDVQGVGLKSLNKAARDLLQRLQKIDGDNYPESLNRMFIINAGSGFRLLWNTIKSFLDPKTTSKIHVLGNKYQSKLLEIIDASELPEFLGGTCTCADKGGCMLSDKGPWNDPDILKMV

SEQ ID NO: 343 - DNA, 1368 bp, Glycine max
  unsure (1246): n is a, c, g or t
  unsure (1282): n is a, c, g or t
gcacgagcaacaatggaacgctatctcaagtaccatgtaaaagagtttgaaaggaccttcgctgttaagttgcctgcatgttctatcgcggcaaagaagcacattgaccaaagcacaactattttggatgttcaaggagtgggtcttaaaagtttgaacaaagctgcaagggatctcctccagaggcttcagaaaattgacggtgacaactaccctgagtcactgaaccgtatgttcatcatcaatgctggttctggatttaggctcttgtggaacaccattaagtcattcctagatcccaagaccacctcaaaaatccatgtcctaggtaacaaataccagagcaagttgcttgaaatcattgatgccagtgaacttccagagttcttgggtggtacttgtacttgtgcagataaaggtggttgtatgctttctgacaagggtccatggaatgacccagatatcttgaagatggttcacaatggcgagggcaaatgcaagagaaaaaccttatctgggattgaggagaaaagaatcatagaagatggtactgcaaatcaaaatctaggaaacaaagaatcatttccagagagatacgatgttgatgtacaatgtttatctccaaaaaagcaatgtactgtgtataaatatgacgcatttgtccctgtgcttggcaagccagtcgattcatcttggaatacattaacacagaaagataaagatgctctttctaaaggtgcagattgttttcctagcaagacttgtgatgggtatagcaatcactttgttggaggaatcatggccattgttatgggaattgtaacaatgatccgcatgacaaggaacatgccaaggaaaatcacagaagcagcactgtatggcagctcagggtattatgatggcactatgatgaaagcagccaccttttcatgcaatgattacatggccatgatgaagcgcatggctgaactagaagagaaagtcactatccttagcatgaaacctgtcattccacccgaaaaggaggaagtgctgaataatgctctaggcagagtcaccactatcgaacatgacttggttgcaacaaaaaaggcacttgatgatgccccttgccgacaagtagactcccaagctcaaattgacaagaagaagaacagcaacaagaagttgttccgcttccgctgtttcgctacgtgatttcaaatgttttactgcatcaggaagagttgtaaaactggaggttttntacttcgactgcctattcagtgtttgattaaaaaanttctgtccaatataaagtttgccatcccttgaaaaaaaaaaaaaaaaaaaaaaaaaaaaaaaaaaaaaaactcgagactagttctc

SEQ ID NO: 344 - protein, 398 aa, Glycine max
ARATMERYLKYHVKEFERTFAVKLPACSIAAKKHIDQSTTILDVQGVGLKSLNKAARDLLQRLQKIDGDNYPESLNRMFIINAGSGFRLLWNTIKSFLDPKTTSKIHVLGNKYQSKLLEIIDASELPEFLGGTCTCADKGGCMLSDKGPWNDPDILKMVHNGEGKCKRKTLSGIEEKRIIEDGTANQNLGNKESFPERYDVDVQCLSPKKQCTVYKYDAFVPVLGKPVDSSWNTLTQKDKDALSKGADCFPSKTCDGYSNHFVGGIMAIVMGIVTMIRMTRNMPRKITEAALYGSSGYYDGTMMKAATFSCNDYMAMMKRMAELEEKVTILSMKPVIPPEKEEVLNNALGRVTTIEHDLVATKKALDDAPCRQVDSQAQIDKKKNSNKKLFRFRCFAT

SEQ ID NO: 345 - DNA, 786 bp, Glycine max
  unsure (676): n is a, c, g or t
  unsure (731): n is a, c, g or t
acgagagaagaaggaagttgaagtgacggaagagaagaaggaagtggaagtgaccgaaggaaagaaagaagtggaagtgatcgaagagaagaaggaaacagaagtgacagaagaaaagaaagaagtggaagtagaagtgagggaagagaagaaggaaagtgaagtgaaagaagaagaaaaaggtcgggaggttgttccagaggaagttgagatatggggaattcccctgctgggggacgagaggagcgatgtgattctgctaaagtttcttagggcaagggatttcaaggtgaaggaggccttgaacatgataagaaacacggtgcgatggagaaaggaatttggaatagagggtctagtggaggaagatcttggaagtgattgggagaaggtggtgttcaaggatggatacgacaaagaagggcacccggtgtactacaacgtctttggggagtttgaggacaaggagttgtacagcaagacgtttttggacgaggaaaagaggaacaagttcataaggtggaggattcagtcgttggagaagagcgttagaagccttgacttctctccgaatgggatatcgacaatagttcaggtgaacgaccttaagaactctcccggactgggcaagagggaactgaggcaggccaccaatcaggcccttcaactgcttcangacaactaccctgagttcgttgccaagcagatattcatcaatgtcccctggtggntacttgccttttctaggatgatcagtcccttcttcacacagaggaccaagagtaa

SEQ ID NO: 346 - protein, 261 aa, Glycine max
  UNSURE (225): Xaa can be any naturally occurring amino acid
  UNSURE (244): Xaa can be any naturally occurring amino acid
REKKEVEVTEEKKEVEVTEGKKEVEVIEEKKETEVTEEKKEVEVEVREEKKESEVKEEEKGREVVPEEVEIWGIPLLGDERSDVILLKFLRARDFKVKEALNMIRNTVRWRKEFGIEGLVEEDLGSDWEKVVFKDGYDKEGHPVYYNVFGEFEDKELYSKTFLDEEKRNKFIRWRIQSLEKSVRSLDFSPNGISTIVQVNDLKNSPGLGKRELRQATNQALQLLXDNYPEFVAKQIFINVPWWXLAFSRMISPFFTQRTKS

SEQ ID NO: 347 - DNA, 564 bp, Glycine max
  unsure (468): n is a, c, g or t
gcacgagcagaagtttagctgaggtttctgttccactgaattggttttatctgttgggggccttgaatttgatgttttctttcgtccacaaaacaactttcatattcatttaacagtgttcacatgtcagggcctcttgatcggtttgcacgtccctgctttgaagggttctctggtcatgatgaaaggagggagaggaaatcagattttgagaactcggaagacgataggcgaacaaggattggtagcttgaaaaagagagcaatcaatgcttcaagcaagttcaggcattctcttaggaagaagagcagcaggagaaagactgcaagccgaagcaattcggtttccattgaggatgttcgagatgttaaggagcttcaagcagtggatgaatttcgacaggcgcttatattggataacttggtggcaacgagacatgatgactatcaaacgttactgagattcttngaaacaagggaatttgaaattgaaaacaaaacagatttgggcaacaatatcaactggggaaaccaattggcccgaaaattagggtgaattcttttt

SEQ ID NO: 348 - protein, 133 aa, Glycine max
  UNSURE (115): Xaa can be any naturally occurring amino acid
MSGPLDRFARPCFEGFSGHDERRERKSDFENSEDDRRTRIGSLKKRAINASSKFRHSLRKKSSRRKTASRSNSVSIEDVRDVKELQAVDEFRQALILDNLVATRHDDYQTLLRFXETREFEIENKTDLGNNIN

SEQ ID NO: 349 - DNA, 466 bp, Glycine max
  unsure (18): n is a, c, g or t
  unsure (46): n is a, c, g or t
  unsure (50): n is a, c, g or t
  unsure (168): n is a, c, g or t
  unsure (221): n is a, c, g or t
  unsure (301): n is a, c, g or t
  unsure (321): n is a, c, g or t
  unsure (335): n is a, c, g or t
  unsure (339): n is a, c, g or t
  unsure (346)..(347): n is a, c, g or t
  unsure (359): n is a, c, g or t
  unsure (419): n is a, c, g or t
  unsure (421): n is a, c, g or t
  unsure (433): n is a, c, g or t
  unsure (447): n is a, c, g or t
  unsure (449): n is a, c, g or t
cttcgttgacatgtctancaatctctgctttgaaggaatggatganaggngagagaggaagttgagttttgagaataattctgaggatgatagatgggcaaaaattggtagcctgaaaaagaaagcattattcgcgtccaccaaatttagacattcttttaagaaganaagaagcagaaaaattgatagcaggagcaattccctctccattgaggatgtgngagatgttaaagaccttcaagcagtggatgcatttcgacaggcactagtgttagataacatgcttcctccaatacatgangactatcatatgctaatganattctgaaagcaangagnttgatanngagaaagcaaancacatgtgggccaatatgatccaatggaggaaagaatatggtacagatacatttatggangnatttgaaatcanggagttgatgagtncngaagtactacccgctag

SEQ ID NO: 350 - protein, 164 aa, Glycine max
TSFVDMSTNLCFEGMDERRERKLSFENNSEDDRWAKIGSLKKKALFASTKFRHSFKKKRSRKIDSRSNSLSIEDVRDVKDLQAVDAFRQALVLDNMLPPIHDDYHMLLRFLKARKFDIEKAKHMWANMIQWRKEYGTDTIMEDFEFKELNEVLKYYPHGYHGCR

SEQ ID NO: 351 - DNA, 1785 bp, Glycine max
atgtctaccaatctctgctttgaaggaatggatgaaaggcgagagaggaagttgagttttgagaataattctgaggatgatagatgggcaaaaattggtagcctgaaaaagaaagcattattcgcgtccaccaaatttagacattcttttaagaagaaaagaagcagaaaaattgatagcaggagcaattccctctccattgaggatgtgcgagatgttaaagaccttcaagcagtggatgcatttcgacaggcactagtgttagataacatgcttcctccaatacatgatgactatcatatgctattgagattcttgaaagcaaggaagtttgatattgagaaagcaaagcacatgtgggccaatatgatccaatggaggaaagaatatggtacagatacaattatggaggattttgaattcaaggagttgaatgaagtcctgaagtactacccgcatggttatcatggtgtagatagggaaggaagacctgtttatattgagaggctagggaaagttgatcccaataggcttatgcaagtaactaccttggaaaggtatttgagataccatgtgcagggttttgagaaaacatttgctgttaagtttccggcttgctcaatagctgctaaaagacacatagattcaagtacaaccattttggatgttcaaggcgtgggcttcaaaaacctaacaaagtctgcacgggaactcatcacccggctgcagaagattgatggtgattactatcctgaaacactctgccaaatgtttatcattaatgctggtcctggttttaagatgctctggaacacggtgaaaacatttcttgatcccaaaactacttcaaagagtcatgttcttggaaacaacgtgctcactgataaaatacttgagattatagatgagagtgagctgccagaatttcttgctggtagttgcacttgtgtagatcaaggtggttgtatgaggtctgataaagggccatggcaagacccaaacattttaaagatggttgtctatgtggtgaagttagatgtttttagcaaaatagtaacagtttccaatgatgaggggagggtgattgaatgtgacaagatatcttatccaatgattagaggtagcgatacatctacaggagaatcaggatctgaagttgaagatatagcttctcccaaagcatgtgggaattgtataagctctatgttaactcctgtccttgaagaagcaagaatggttggcaagactagtcatgctggaagtttagttgagtatgttcccatggttgacaaagccattaatgttggatcaaaggaaaagcaagcaacacctcgaaagttattttgttcaacagcgggcttcattttggccctatatacttttgctcgatcaataacatttcgtgtcactaagggaatgcggtactcagaatctaattctgccagaaatatacttaacatgactgttgactcaatatccaagggggaatctcgtcctccttcatattctcccggcggattcacaaaggcaaaccttccctcatctaccttaaaacgccttggtgagcttgaagagaaagttgatatgctacagtcaaagcctagtgtgatgccacatgagaaagaggagctacttaatgctgctgtttatcgtgtcgatgcattggaagcagagttgattgctacaaagaaggctttgtacgaagctttgataagacaagaagagcttatggcatatatagacagtcaggaaagagacaaattcaagagaaagggttgctggtga

SEQ ID NO: 352 - protein, 594 aa, Glycine max
MSTNLCFEGMDERRERKLSFENNSEDDRWAKIGSLKKKALFASTKFRHSFKKKRSRKIDSRSNSLSIEDVRDVKDLQAVDAFRQALVLDNMLPPIHDDYHMLLRFLKARKFDIEKAKHMWANMIQWRKEYGTDTIMEDFEFKELNEVLKYYPHGYHGVDREGRPVYIERLGKVDPNRLMQVTTLERYLRYHVQGFEKTFAVKFPACSIAAKRHIDSSTTILDVQGVGFKNLTKSARELITRLQKIDGDYYPETLCQMFIINAGPGFKMLWNTVKTFLDPKTTSKSHVLGNNVLTDKILEIIDESELPEFLAGSCTCVDQGGCMRSDKGPWQDPNILKMVVYVVKLDVFSKIVTVSNDEGRVIECDKISYPMIRGSDTSTGESGSEVEDIASPKACGNCISSMLTPVLEEARMVGKTSHAGSLVEYVPMVDKAINVGSKEKQATPRKLFCSTAGFILALYTFARSITFRVTKGMRYSESNSARNILNMTVDSISKGESRPPSYSPGGFTKANLPSSTLKRLGELEEKVDMLQSKPSVMPHEKEELLNAAVYRVDALEAELIATKKALYEALIRQEELMAYIDSQERDKFKRKGCW

SEQ ID NO: 353 - DNA, 1341 bp, Triticum aestivum
gcacgagatgttatggagcacaataaaatcattcctcgatccaaaaactgcttccaagatccatgttcttgggaataagtatcaacataagttgctcgaaataattgacgagtgtgaactgccagaatttcttggtggcaaatgcaattgtattgaaggttgccaaagatctgacaaaggtccttggaaggatcccaacataataaagagagtcctcaatgacgaggcaaactacggcagacaaattgtgaccatatccagcattgatggaaaaataatacgttatgctaggccagatcacccaactagaaaagggagtgatgcatctgccgagtctggatctgaagtggaagatgtaacatctcctactgcatcaaggaacctgattacacatcctattttgacccctgttcacgaagagtcaaaattgtcgccacatggttccacatttgttgctcatgcttctattgaagaaaacattcctgttgtagacaaggttgtggatgatggatggggtactcccagaggtagtctccaagcttcttcaggttcgttgccctcgagaaacacgcacggcacattcgaaggactgagagttcaagctgtcgcatggctgacgttcttgatcacggcccttttcgccacgctctgttccgtcccgagcaagatggccagaaggatctccagccagtctagcaagcacgacgactaccgcggcgagtatcctcaagaggaggaggagcacaaggaggagttccggcctccgtctcctgccccgtcctacacggagaaggacgtgctctcgtcgatgctgagacggctcggtgagctggagggcagggtgcaggtgctcgagacgaagccgtccgagatgccgtttgagaaggaggagctgctcaacgcagccgtccgccgcgtggacgcgctggaagccgagctgatctccacgaagaaggccctttacgatgctctgatgcgacaggatgagctgctcgcgtacattgacaggcaggagctgatcaagttccgtaaaaagaagttctgcttctaagatctgaccatggagcagctggtcatgtccggagccgttcgtgtatattgttggatcgcggctagtacggtgaatgatgtaatgtgtccatctgtacaagtgtgtaacggaacggtgtaagtatagtaggaaaacaatgtgttagctgtgcggtagcacttgtgtgctagcctaaattgtaatcttgcaagtcggtgcatagctgattgcgcaccaatacgtagttatgaatggaatcgcactcgtgttcgtataaaataaaataaattagcaaaaaaaaaaaaaaaaaa

SEQ ID NO: 354 - protein, 349 aa, Triticum aestivum
HEMLWSTIKSFLDPKTASKIHVLGNKYQHKLLEIIDECELPEFLGGKCNCIEGCQRSDKGPWKDPNIIKRVLNDEANYGRQIVTISSIDGKIIRYARPDHPTRKGSDASAESGSEVEDVTSPTASRNLITHPILTPVHEESKLSPHGSTFVAHASIEENIPVVDKVVDDGWGTPRGSLQASSGSLPSRNTHGTFEGLRVQAVAWLTFLITALFATLCSVPSKMARRISSQSSKHDDYRGEYPQEEEEHKEEFRPPSPAPSYTEKDVLSSMLRRLGELEGRVQVLETKPSEMPFEKEELLNAAVRRVDALEAELISTKKALYDALMRQDELLAYIDRQELIKFRKKKFCF

SEQ ID NO: 355 - DNA, 1259 bp, Triticum aestivum
  unsure (1047): n is a, c, g or t
  unsure (1102): n is a, c, g or t
  unsure (1112): n is a, c, g or t
  unsure (1137): n is a, c, g or t
  unsure (1159): n is a, c, g or t
  unsure (1161): n is a, c, g or t
  unsure (1164): n is a, c, g or t
  unsure (1169): n is a, c, g or t
  unsure (1180)..(1181): n is a, c, g or t
  unsure (1185): n is a, c, g or t
  unsure (1193): n is a, c, g or t
  unsure (1213): n is a, c, g or t
  unsure (1229): n is a, c, g or t
  unsure (1235)..(1236): n is a, c, g or t
  unsure (1248): n is a, c, g or t
  unsure (1252): n is a, c, g or t
acgaagttatgaagtattatccacagttttaccatggggtggataaagatggaagacctgtctatgtggagttaataggaaaagttgatgccaacaaggtgctgcaagtaacaactatagaccgatatgtgaaatatcatgtcaaggagtttgagaaatgtttccagatgagatttccagcttgctcaattgctgcaaaacggcacctggactcatgcacaactattctggatgtgcaaggcgtgggattgaagaacttctcgaaatgtgcaagggaactaatcacccgactgcagaagattgacagtgacaactacccagagacattatgccggatgtacataattaatgctggccaaggcttcaagatgttatggggcacaataaagtcttttcttgattcgaaaactgcttcaaagattcatgttcttggaaccaagtaccaaaataagctacttgaaataattgatgagagtgaattgccagaattttttggtggcaaatgcaagtgtgaagaacatggaggttgtcagagatcagataaaggtccttggaaggatcccaccacaataaagagggtcctgaatggcgaggcaaactacgacagacaaatcgtgaccatatcaggcactgatggcaagatcatcagttatgctaggccacagcgcccaaatggaaagggcagtgatgcatctgctgagtctgggtctgaagtggaagatgttacatctcctattgcaccaaagaccctcataacgaatccttctttgacccctgttcatgaggagtcaaaatttgcagcacatgcatccacgtctgctgctcgccccactattgaagaaagcatccctgttgttgacaaggttgtggacgacggatggagcagccccagagctagtccagtgtcctcttcctcaggttcattatccttgagaaatctaccgaccacattcgaaggaattcggaccttggttgtcgcatggctgacagtcttcatcgtgaccttttcgccatgcttcgaagtatcccgagcaaaatggcaaaagntctcgaacaatccatgatcacgacactattacgtggactgcctcaagacaagatncaaggaggantccgactcgttcctgccccggctanacgagaaggaaccttcaacccngnaanacgcnagtaactgagnnaagncaagcctnaaaaaccaccagatcatcanaagggggtgcatctcncccctnngacctgaaccantatntaaagag

SEQ ID NO: 356 - protein, 335 aa, Triticum aestivum
EVMKYYPQFYHGVDKDGRPVYVELIGKVDANKVLQVTTIDRYVKYHVKEFEKCFQMRFPACSIAAKRHLDSCTTILDVQGVGLKNFSKCARELITRLQKIDSDNYPETLCRMYIINAGQGFKMLWGTIKSFLDSKTASKIHVLGTKYQNKLLEIIDESELPEFFGGKCKCEEHGGCQRSDKGPWKDPTTIKRVLNGEANYDRQIVTISGTDGKIISYARPQRPNGKGSDASAESGSEVEDVTSPIAPKTLITNPSLTPVHEESKFAAHASTSAARPTIEESIPVVDKVVDDGWSSPRASPVSSSSGSLSLRNLPTTFEGIRTLVVAWLTVFIVTF

SEQ ID NO: 357 - DNA, 1747 bp, Triticum aestivum
gcacgaggtttgagagagcattccgtgagaagtttcctgcctgctcaattgctgctcaaaagcatatagatacaacaaccacaatattggatgtccatggcgtgggctggaagaactttggtaagattgcaagggatttagtgcgctgtatgcagaaaatagatggtgactattatcctgagacactacatcaaatgttcattgtaaatgctggagctggtttcaaactgatctggagcactataaagggacttcttgaccccaaaacatcatcaaaaattcatgttctaggagcaaaataccagagcaggcttcttgaagctattgacgcaagccaattaccagagttttttggtggtttgtgcacatgctctaaccagggaggatgcctgaggtccaacaaaggcccttggagtgaccctttaattatgaagatagtacatagcatggaatcatctgcattaagggatatcgtgcaagtatctgatatagaagaaacaattacaggctctgttagaatgcgtgcgcccaagttaccaaaaagaattaatgatacatcaaatgccgaatcaaggtcaaatgttgatgatcttggatcccctgtagcccctgaagatgttgaatatcatagtttggctccaatccgtgaggaagccagggaatcaggatcaacaatatacggctgttcagacgatcgacctctttcagtggataaagctgttgagtccaataaaagatataaccttactggaaatgtattaaggcagtacaacacacgacaaaattcatcgatgaatagagttttgcctgagccaggtcgtgccccaaatgtccgtgaaggcgatgcagatgatgggattttgaaattattttcaagaaaagttcttgctgtaattctcaaagtactctctcttttgcgcttgttcactcgccatcagcaacacttggaaaatgttcatccgcatactgcagccgtacccagtaatcaaccaaatcttcagatagttaaggaagaccgagtaaatccttgtttggagcgtcttgaaagacttgagtcgatgtgtaatcaactcagcagaaagcctcctgagatcccacaggataaggatcgtgctatacaggattcttttgataggataaaatccattgaatttgacctggagaagacaaagaaggtattgcatgcaacagtgatcaaacaaatgcagatggctgaaacattggagtccgtgacagagtctggtcatcatagaagaaggaaattttgtacttaataaactcacagcaatgtacatgaacaagaaaaaaaaacagagatggcgactttgatgactgctttccgacagaaactaaacagcattgctttgtatatggctgctcagtctcgcttctctttttggtcaatcaaaaagatgggtgatgttaataagaaggatagatagttggtgaccggaggaaaactgaggggatggtcaagaagagcgccctggaagataactgaatatagcgaagataactgaatatagcgcggcttatatacagcaaaagaaagttgaaagatgaatcccgacgcacagctcatgttctttgtatgttttctgttttctctgcctctatgcgcctcctgatctgctgtatgcctgtatttgaatgcttatgcgcattttcattgtcagaacagttgaggctggggtctcataattaacaccattctttggttaaaaaaaaaaaaaaaaaaaaaaaaaaa

SEQ ID NO: 358 - protein, 423 aa, Triticum aestivum
TRFERAFREKFPACSIAAQKHIDTTTTILDVHGVGWKNFGKIARDLVRCMQKIDGDYYPETLHQMFIVNAGAGFKLIWSTIKGLLDPKTSSKIHVLGAKYQSRLLEAIDASQLPEFFGGLCTCSNQGGCLRSNKGPWSDPLIMKIVHSMESSALRDIVQVSDIEETITGSVRMRAPKLPKRINDTSNAESRSNVDDLGSPVAPEDVEYHSLAPIREEARESGSTIYGCSDDRPLSVDKAVESNKRYNLTGNVLRQYNTRQNSSMNRVLPEPGRAPNVREGDADDGILKLFSRKVLAVILKVLSLLRLFTRHQQHLENVHPHTAAVPSNQPNLQIVKEDRVNPCLERLERLESMCNQLSRKPPEIPQDKDRAIQDSFDRIKSIEFDLEKTKKVLHATVIKQMQMAETLESVTESGHHRRRKFCT

SEQ ID NO: 359 - DNA, 475 bp, Triticum aestivum
  unsure (36): n is a, c, g or t
  unsure (285): n is a, c, g or t
  unsure (298): n is a, c, g or t
  unsure (368): n is a, c, g or t
  unsure (440): n is a, c, g or t
  unsure (463): n is a, c, g or t
  unsure (475): n is a, c, g or t
ctccacccgaggggagaaggaaaagaaagctccggnctcgcccctgcctgcctgcctgcctgctgtcccaagccccaagccaagattccctcgttgcatcggcgtaaatagcgccattccaacgcgggctccgagctggtgtccaagaagttgaatttggaggagaaaatgtcggtgatccatgccgacgacatcgagatatcgctgtgcgacggcaactcggaggacgagcgccgccgccggaagatagggtcgctgcgccgcaaggccatccacgcgctcaanaagcgcggcaggngtcgcgtcgacttccgcttcccgccgggcatctccatcgaggacgtccgcgaagccgaggaggagcgcgncgtctccgccttccgtgagcgtctgggcgcgcacgggctcctggccgacaaagcacgaagaactaacaaatnatgctaaaggtcttgaaggctangaaagttcgacn

SEQ ID NO: 360 - protein, 89 aa, Triticum aestivum
  UNSURE (39): Xaa can be any naturally occurring amino acid
  UNSURE (44): Xaa can be any naturally occurring amino acid
  UNSURE (67): Xaa can be any naturally occurring amino acid
MSVIHADDIEISLCDGNSEDERRRRKIGSLRRKAIHALXKRGRXRVDFRFPPGISIEDVREAEEERXVSAFRERLGAHGLLADKARRTN

SEQ ID NO: 361 - DNA, 424 bp, Triticum aestivum
  unsure (323): n is a, c, g or t
  unsure (350): n is a, c, g or t
  unsure (352): n is a, c, g or t
  unsure (361): n is a, c, g or t
  unsure (364): n is a, c, g or t
  unsure (366): n is a, c, g or t
  unsure (371): n is a, c, g or t
  unsure (378): n is a, c, g or t
  unsure (383): n is a, c, g or t
  unsure (387): n is a, c, g or t
  unsure (391): n is a, c, g or t
  unsure (404): n is a, c, g or t
gcatcctgctcgttccgtaccatcgtccgagctccgccgcctccgcggggcctcgccggggccaggagatcagtccgctgctgcagcaggccgctcccgcaggcgcctccacatccaagctcgtcctggaggtgaaagagaggctcgaaagggagcatccgggcctcccgacgggcaggagcggcagggatgacgacgagatgatcctctggttcttgaaggacaggaagttcgccgtcgacgaagccgtctccaagctggccaaggccatcaaatggcgtcaggatttccgcttgtcagaatatcagaagaatcagtgaaanggtttacaaacttgcaaggatatgtgnanattttttanatnancggcngcctttnttaanatantganccaaaatttcctntaaaaagaccccttaaaaag

SEQ ID NO: 362 - protein, 96 aa, Triticum aestivum
ILLVPYHRPSSAASAGPRRGQEISPLLQQAAPAGASTSKLVLEVKERLEREHPGLPTGRSGRDDDEMILWFLKDRKFAVDEAVSKLAKAIKWRQDF

SEQ ID NO: 363 - protein, 364 aa, Zea mays
MASEPVARAVAEEVGRWGSMKQTGVTLRYMMEFGSRPTQRNLLLSAQFLHKELPIRFARRALELDSLPFGLSNKPAILKVRDWYLDSFRDIRYFPEVRSRNDELAFTQMINMVKVRHNNVVPTMALGVQQLKKELGRSRKVPFEFDEIDEFLDRFYMSRIGIRMLIGQHVALHDPKPEPGVIGLINTRLSPIQVAQAACEDARSVCLREYGSAPDINIYGDPNFTFPYVTLHLHLMLFELVKNSLRAVQERYMNSDKDVPPVRIIVADGEEDVTIKVSDEGGGIPRSGLPRIFTYLYSTAKNPPELDRPNTERVTMAGYGFGLPISRLYARYFGGDLQIISMEGYGTDAYLHLSRLGDSEEPLP

SEQ ID NO: 364 - protein, 324 aa, Glycine max
MGVGSQDAIKQFQAFIDQVEEPLRTTFQNVHQGFVTETLMRFLKARDWDPCKAHKMLVDCLNWRVQNEIDNILSKPIVPADLYRAVRDSQLIGLSGYSREGLPVFAIGVGLSTFDKASVHYYVQSHIQINEYRERIILPSASKKQGRPITTCIKVLDMTGLKLSALNQIKLLTIISSIDDLNYPEKTNTYYIVNAPYIFSACWKVVKPLLQERTRRKIQVLPGCGRDELLTIMDYSSLPHFCRREGSGSSRHSESGSENCYSLDHPFHQELYNHIKQQARLREAVEPIKQGSFHVDFPVPPDDEVEIAKTIESELHKFENGNGV

SEQ ID NO: 365 - protein, 256 aa, Glycine max
MEAVRAGREGAIGLGQGDGVAKDSTETELTKIRLLRAIVETRDPSSKEEDDFMIRRFLRARDLDVEKASAMLLKYLKWRNSFVPNGSVSVSDVPNELAQDKVFMQGHDKIGRPILMVFGGRHFQNKDGLDEFKRFVVYVLDKVCASMPPGQEKFVGIAELKGWGYSNSDVRGYLSALSILQDYYPERLGKLFIVNAPYIFMKVWQIVYPFIDNKTKKKIVFVEKNKVKSTLLEEMEESQVPEIFGGSLPLVPIQDS

SEQ ID NO: 366 - protein, 142 aa, Ricinus communis
MAGVGPISQDWEPVVIRKKAPTAAAKKDEKVVNAARRAGAEIETLKKSNAGTNKAASSSTSLNTRKLDEETENLTHDRVPTELKKAIMQARMEKKFTQAQLAQMINEKPQIIQEYESGKAIPNQQIIGKLERALGVKLRGKK

SEQ ID NO: 367 - protein, 570 aa, Arabidopsis thaliana
MQSAMALSFSQTSFTRPNHVLGSSGSVFSTPRSLRFCGLRREAFGFSTSNQLAIRSNRIQFLSRKSFQVSASASSNGNGAPPKSFDYDLIIIGAGVGGHGAALHAVEKGLKTAIIEGDVVGGTCVNRGCVPSKALLAVSGRMRELQNEHHMKSFGLQVSAAGYDRQGVADHANNLATKIRNNLTNSMKAIGVDILTGFGSVLGPQKVKYGKDNIITAKDIIIATGSVPFVPKGIEVDGKTVITSDHALKLESVPEWIAIVGSGYIGLEFSDVYTALGSEVTFIEALDQLMPGFDPEISKLAQRVLINPRKIDYHTGVFASKITPARDGKPVLIELIDAKTKEPKDTLEVDAALIATGRAPFTNGLGLENVNVVTQRGFIPVDERMRVIDGKGTLVPNLYCIGDANGKLMLAHAASAQGISVVEQVSGRDHVLNHLSIPAACFTHPEISMVGLTEPQAKEKGEKEGFKVSVVKTSFKANTKALAENEGEGIAKMIYRPDNGEILGVHIFGLHAADLIHEASNAIALGTRIQDIKLAVHAHPTLSEVLDELFKAAKVESHATTRTVSEKVVV

SEQ ID NO: 368 - protein, 143 aa, Homo sapiens
MGFPEAASSFRTHQIEAVPTSSASDGFKANLVFKEIEKKLEEEGEQFVKKIGGIFAFKVKDGPGGKEATWVVDVKNGKGSVLPNSDKKADCTITMADSDFLALMTGKMNPQSAFFQGKLKITGNMGLAMKLQNLQLQPGNAKL

SEQ ID NO: 369 - protein, 181 aa, Arabidopsis thaliana
MNLEEKPTMTASRASPQAEHLYYVRCSICNTILAVGIPLKRMLDTVTVKCGHCGNLSFLTTTPPLQGHVSLTLQMQSFGGSDYKKGSSSSSSSSTSSDQPPSPSPPFVVKPPEKKQRLPSAYNRFMRDEIQRIKSANPEIPHREAFSAAAKNWAKYIPNSPTSITSGGHNMIHGLGFGEKK

SEQ ID NO: 370 - protein, 125 aa, Homo sapiens
MEPDGTYEPGFVGIRFCQECNNMLYPKEDKENRILLYACRNCDYQQEADNSCIYVNKITHEVDELTQIIADVSQDPTLPRTEDHPCQKCGHKEAVFFQSHSARAEDAMRLYYVCTAPHCGHRWTE

SEQ ID NO: 371 - protein, 239 aa, Stylosanthes hamata
MAPREKTPAVKVNAGVKEVHFRGVRKRPWGRYAAEIRDPGKKSRVWLGTFDTAEDAARAYDAAAREFRGPKAKTNFPFPDSDDINSNNNNIVVVKNNNRSPSQSSTVESSSRDRDSYSAAAAATAVADSSPLDLNLAPAGAGFAGSIRFPFQQPFAVFPGGMPAAKQALYLDAVLRASMASHGQFGFGYNRPAAAAAGAQSDSDSSSVIDLNQNEGDVAKNNGRGLVLDLNEPPPQEMA

SEQ ID NO: 372 - protein, 428 aa, Nicotiana tabacum
MNGGDMNQQQQQQQQQQQQQQQQQWMAMQQYQQQWMAMQYPAAAMAMRNDRCMVSNTCLQQHQQQQQKMQQSPTQIQSSSEDNKTIWIGDLQQWMDESYLHSCFSQAGEVISVKIIRNKQTGQSERYGFVEFNTHAAAEKVLQSYNGTMMPNAEQPFRLNWAGFSTGEKRAETGSDFSIFVGDLASDVTDTMLRDTFASRYPSLKGAKVVVDANTGHSKGYGFVRFGDESERSRAMTEMNGVYCSSRAMRIGVATPKKPSAQQQYSSQAVILSGGYASNGAATHGSQSDGDASNTTIFVGGLDSDVTDEELRQSFNQFGEVVSVKIPAGKGCGFVQFSDRSSAQEAIQKLSGAIIGKQAVRLSWGRTANKQMRADSGSQWNGGYNGRQNYGGYGYGASQNQDSGMYATGAAAYGASSNGYGNHQQPVS

SEQ ID NO: 373 - protein, 375 aa, Arabidopsis thaliana
MGTTTTTSAVYIHVIEDVVNKVREEFINNGGPGESVLSELQGIWETKMMQAGVLNGPIERSSAQKPTPGGPLTHDLNVPYEGTEEYETPTAEMLFPPTPLQTPLPTPLPGTADNSSMYNIPTGSSDYPTPGTENGVNIDVKARPSPYMPPPSPWTNPRLDVNVAYVDGRDEPERGNSNQQFTQDLFVPSSGKRKRDDSSGHYQNGGSIPQQDGAGDAIPEANFECDAFRITSIGDRKVPRDFFSSSSKIPQVDGPMPDPYDEMLSTPNIYSYQGPSEEFNEARTPAPNEIQTSTPVAVQNDIIEDDEELLNEDDDDDELDDLESGEDMNTQHLVLAQFDKVTRTKSRWKCSLKDGIMHINDKDILFNKAAGEFDF

SEQ ID NO: 374 - protein, 106 aa, Arabidopsis thaliana
MATFELYRRSTIGMCLTETLDEMVQSGTLSPELAIQVLVQFDKSMTEALESQVKTKVSIKGHLHTYRFCDNVWTFILQDAMFKSDDRQENVSRVKIVACDSKLLTQ

SEQ ID NO: 375 - protein, 617 aa, Arabidopsis thaliana
MSGPVDRFAIPCFEGILSSDEKKERKSDFENSEDERRTRIGSLKKKAINASTKFKHSLKKKRRKSDVRVSSVSIEDVRDVEELQAVDEFRQALVMEELLPHKHDDYHMMLRFLKARKFDIEKAKHMWADMIQWRKEFGTDTIIQDFQFEEIDEVLKYYPHGYHSVDKEGRPVYIERLGKVDPNKLMQVTTLDRYIRYHVKEFERSFMLKFPACTIAAKKYIDSSTTILDVQGVGLKNFTKSARELITRLQKIDGDNYPETLHQMFIINAGPGFRLLWSTVKSFLDPKTTSKIHNYSILLCFAYISDVSFICFSELPEFLGGACTCADQGGCMLSDKGPWKNPEIVKMVLHGGAHRAKQVVKVLNSDGKVIAYAKPSYPWIKGSDTSTAESGSEAEDIVVSPKAVKSYSHLRLTPVREEAKVGSGETSFAGSFAGYDEYVPMVDKAVDATWKVKPTAINRAPSKGAHMPPNVPKDHESFSARVLVTFMAFVMAILTFFRTVSNRVVTKQLPPPPSQPQIEGSAAAEEADLLNSVLKKLTELEEKIGALQSKPSEMPYEKEELLNAAVCRVDALEAELIATKKALYEALMRQEELLAYIDRQEAAQHQKKNKRKQMFCF

SEQ ID NO: 376 - DNA, 36 bp, Artificial Sequence
  Description of Artificial Sequence: Sal-A20 oligonucleotide
tcgacccacgcgtccgaaaaaaaaaaaaaaaaaaaa

What is claimed is:

1. An isolated polynucleotide comprising:
   (a) a nucleotide sequence encoding a polypeptide having pyruvate dehydrogenase kinase activity, wherein the amino acid sequence of the polypeptide and SEQ ID NO:14 have at least 90% sequence identity, based on the Clustal alignment method with pairwise alignment default parameters of KTUPLE=1, GAP PENALTY=3, WINDOW=5 and DIAGONALS SAVED=5; or
   (b) a complement of the nucleotide sequence of (a), wherein the complement and the nucleotide sequence consist of the same number of nucleotides and are 100% complementary.

2. The polynucleotide of claim 1, wherein the amino acid sequence of the polypeptide and SEQ ID NO:14 have at least 95% sequence identity, based on the Clustal alignment method with the pairwise alignment default parameters.

3. The polynucleotide of claim 1, wherein the amino acid sequence of the polypeptide comprises SEQ ID NO:14.

4. The polynucleotide of claim 1, wherein the nucleotide sequence comprises SEQ ID NO:13.

5. A vector comprising the polynucleotide of claim 1.

6. A recombinant DNA construct comprising the polynucleotide of claim 1 operably linked to at least one regulatory sequence.

7. A method for transforming a cell, comprising transforming a cell with the polynucleotide of claim 1.

8. A cell comprising the recombinant DNA construct of claim 6.

9. A method for producing a transgenic plant comprising transforming a plant cell with the polynucleotide of claim 1 and regenerating a transgenic plant from the transformed plant cell.

10. A plant comprising the recombinant DNA construct of claim 6.

11. A seed comprising the recombinant DNA construct of claim 6.

* * * * *